United States Patent 12,371,699 (NUCLEIC ACIDS ENCODING CRISPR-ASSOCIATED PROTEINS AND USES THEREOF) - sequence listing, part 14

SEQ ID NO: 10555 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10556 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10557 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10558 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10559 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10560 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10561 - RNA, 4257 nt, synthetic construct
  misc_feature 1..4257: note = Cpf1 variant mRNA product
  source 1..4257: mol_type = other RNA
gggagagtcccgcagtcggcgtccagcggctctgcttgttcgtgtgtgtgtcgttgcaggccttattcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagttgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10562 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10563 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10564 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10565 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10566 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10567 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10568 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10569 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10570 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10571 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10572 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10573 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10574 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctcctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10575 - protein, 16 aa, synthetic construct
  REGION 1..16: note = NLS3
KRPAATKKAGQAKKKK

SEQ ID NO: 10576 - protein, 1323 aa, synthetic construct
  REGION 1..1323: note = Cpf1 variant protein
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKK

SEQ ID NO: 10577 - protein, 1316 aa, synthetic construct
  REGION 1..1316: note = Cpf1 variant protein
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNKRPAATKKAGQAKKKK

SEQ ID NO: 10578 - RNA, 48 nt, synthetic construct; identical to SEQ ID NO: 1379
  misc_feature 1..48: note = NLS3 variant
  source 1..48: mol_type = other RNA

SEQ ID NO: 10579 - RNA, 3972 nt, synthetic construct
  misc_feature 1..3972: note = Cpf1 variant
  source 1..3972: mol_type = other RNA
atgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtga

SEQ ID NO: 10580 - RNA, 3951 nt, synthetic construct
  misc_feature 1..3951: note = Cpf1 variant
  source 1..3951: mol_type = other RNA
atgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtga

SEQ ID NO: 10581 - RNA, 48 nt, synthetic construct; identical to SEQ ID NO: 2539
  misc_feature 1..48: note = NLS3 variant
  source 1..48: mol_type = other RNA

SEQ ID NO: 10582 - RNA, 3972 nt, synthetic construct
  misc_feature 1..3972: note = Cpf1 variant
  source 1..3972: mol_type = other RNA
atgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatga

SEQ ID NO: 10583 - RNA, 3951 nt, synthetic construct
  misc_feature 1..3951: note = Cpf1 variant
  source 1..3951: mol_type = other RNA
atgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtga

SEQ ID NO: 10584 - RNA, 48 nt, synthetic construct; identical to SEQ ID NO: 3699
  misc_feature 1..48: note = NLS3 variant
  source 1..48: mol_type = other RNA

SEQ ID NO: 10585 - RNA, 3972 nt, synthetic construct
  misc_feature 1..3972: note = Cpf1 variant
  source 1..3972: mol_type = other RNA
atgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatga

SEQ ID NO: 10586 - RNA, 3951 nt, synthetic construct
  misc_feature 1..3951: note = Cpf1 variant
  source 1..3951: mol_type = other RNA
atgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtga

SEQ ID NO: 10587 - RNA, 48 nt, synthetic construct; identical to SEQ ID NO: 4859
  misc_feature 1..48: note = NLS3 variant
  source 1..48: mol_type = other RNA

SEQ ID NO: 10588 - RNA, 3972 nt, synthetic construct
  misc_feature 1..3972: note = Cpf1 variant
  source 1..3972: mol_type = other RNA
atgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataa

SEQ ID NO: 10589 - RNA, 3951 nt, synthetic construct
  misc_feature 1..3951: note = Cpf1 variant
  source 1..3951: mol_type = other RNA
atgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataa

SEQ ID NO: 10590 - RNA, 48 nt, synthetic construct; identical to SEQ ID NO: 6019
  misc_feature 1..48: note = NLS3 variant
  source 1..48: mol_type = other RNA

SEQ ID NO: 10591 - RNA, 3972 nt, synthetic construct
  misc_feature 1..3972: note = Cpf1 variant
  source 1..3972: mol_type = other RNA
atgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataa

SEQ ID NO: 10592 - RNA, 3951 nt, synthetic construct
  misc_feature 1..3951: note = Cpf1 variant
  source 1..3951: mol_type = other RNA
atgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataa

SEQ ID NO: 10593 - RNA, 48 nt, synthetic construct
  misc_feature 1..48: note = NLS3 variant
  source 1..48: mol_type = other RNA
aaacgcccggccgcaaccaaaaaagcaggccaggccaaaaaaaaaaaa

SEQ ID NO: 10594 - RNA, 3972 nt, synthetic construct
  misc_feature 1..3972: note = Cpf1 variant
  source 1..3972: mol_type = other RNA
atgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtga

SEQ ID NO: 10595 - RNA, 3951 nt, synthetic construct; identical to SEQ ID NO: 10580
  misc_feature 1..3951: note = Cpf1 variant
  source 1..3951: mol_type = other RNA

SEQ ID NO: 10596 - RNA, 48 nt, synthetic construct; identical to SEQ ID NO: 4859
  misc_feature 1..48: note = NLS3 variant
  source 1..48: mol_type = other RNA

SEQ ID NO: 10597 - RNA, 3972 nt, synthetic construct
  misc_feature 1..3972: note = Cpf1 variant
  source 1..3972: mol_type = other RNA
atgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatga

SEQ ID NO: 10598 - RNA, 3951 nt, synthetic construct
  misc_feature 1..3951: note = Cpf1 variant
  source 1..3951: mol_type = other RNA
atgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatag

SEQ ID NO: 10599 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10600 - RNA, 4467 nt, synthetic construct
  misc_feature 1..4467: note = Cpf1 variant mRNA product
  source 1..4467: mol_type = other RNA
gggagagtcccgcagtcggcgtccagcggctctgcttgttcgtgtgtgtgtcgttgcaggccttattcaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10601 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10602 - RNA, 4467 nt, synthetic construct
  misc_feature 1..4467: note = Cpf1 variant mRNA product
  source 1..4467: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10603 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10604 - RNA, 4467 nt, synthetic construct
  misc_feature 1..4467: note = Cpf1 variant mRNA product
  source 1..4467: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10605 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10606 - RNA, 4467 nt, synthetic construct
  misc_feature 1..4467: note = Cpf1 variant mRNA product
  source 1..4467: mol_type = other RNA
gggagagtcccgcagtcggcgtccagcggctctgcttgttcgtgtgtgtgtcgttgcaggccttattcaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10607 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10608 - RNA, 4467 nt, synthetic construct
  misc_feature 1..4467: note = Cpf1 variant mRNA product
  source 1..4467: mol_type = other RNA
gggagagtcccgcagtcggcgtccagcggctctgcttgttcgtgtgtgtgtcgttgcaggccttattcaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10609 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10610 - RNA, 4467 nt, synthetic construct; identical to SEQ ID NO: 10600
  misc_feature 1..4467: note = Cpf1 variant mRNA product
  source 1..4467: mol_type = other RNA

SEQ ID NO: 10611 - RNA, 4488 nt, synthetic construct
  misc_feature 1..4488: note = Cpf1 variant mRNA product
  source 1..4488: mol_type = other RNA
gggagagtcccgcagtcggcgtccagcggctctgcttgttcgtgtgtgtgtcgttgcaggccttattcaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10612 - RNA, 4467 nt, synthetic construct
  misc_feature 1..4467: note = Cpf1 variant mRNA product
  source 1..4467: mol_type = other RNA
gggagagtcccgcagtcggcgtccagcggctctgcttgttcgtgtgtgtgtcgttgcaggccttattcaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10613 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10614 - RNA, 4564 nt, synthetic construct
  misc_feature 1..4564: note = Cpf1 variant mRNA product
  source 1..4564: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10615 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10616 - RNA, 4564 nt, synthetic construct
  misc_feature 1..4564: note = Cpf1 variant mRNA product
  source 1..4564: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10617 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10618 - RNA, 4564 nt, synthetic construct
  misc_feature 1..4564: note = Cpf1 variant mRNA product
  source 1..4564: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10619 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10620 - RNA, 4564 nt, synthetic construct
  misc_feature 1..4564: note = Cpf1 variant mRNA product
  source 1..4564: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10621 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10622 - RNA, 4564 nt, synthetic construct
  misc_feature 1..4564: note = Cpf1 variant mRNA product
  source 1..4564: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10623 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10624 - RNA, 4564 nt, synthetic construct; identical to SEQ ID NO: 10614
  misc_feature 1..4564: note = Cpf1 variant mRNA product
  source 1..4564: mol_type = other RNA

SEQ ID NO: 10625 - RNA, 4585 nt, synthetic construct
  misc_feature 1..4585: note = Cpf1 variant mRNA product
  source 1..4585: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10626 - RNA, 4564 nt, synthetic construct
  misc_feature 1..4564: note = Cpf1 variant mRNA product
  source 1..4564: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10627 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10628 - RNA, 4248 nt, synthetic construct
  misc_feature 1..4248: note = Cpf1 variant mRNA product
  source 1..4248: mol_type = other RNA
gggagagcggctcggccattttgtcccagtcagtccggaggctgcggctgcagaagtaccgcctgcggagtaactgcaaagaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10629 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10630 - RNA, 4248 nt, synthetic construct
  misc_feature 1..4248: note = Cpf1 variant mRNA product
  source 1..4248: mol_type = other RNA
gggagagcggctcggccattttgtcccagtcagtccggaggctgcggctgcagaagtaccgcctgcggagtaactgcaaagaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10631 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10632 - RNA, 4248 nt, synthetic construct
  misc_feature 1..4248: note = Cpf1 variant mRNA product
  source 1..4248: mol_type = other RNA
gggagagcggctcggccattttgtcccagtcagtccggaggctgcggctgcagaagtaccgcctgcggagtaactgcaaagaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10633 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10634 - RNA, 4248 nt, synthetic construct
  misc_feature 1..4248: note = Cpf1 variant mRNA product
  source 1..4248: mol_type = other RNA
gggagagcggctcggccattttgtcccagtcagtccggaggctgcggctgcagaagtaccgcctgcggagtaactgcaaagaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10635 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10636 - RNA, 4248 nt, synthetic construct
  misc_feature 1..4248: note = Cpf1 variant mRNA product
  source 1..4248: mol_type = other RNA
gggagagcggctcggccattttgtcccagtcagtccggaggctgcggctgcagaagtaccgcctgcggagtaactgcaaagaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10637 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10638 - RNA, 4248 nt, synthetic construct; identical to SEQ ID NO: 10628
  misc_feature 1..4248: note = Cpf1 variant mRNA product
  source 1..4248: mol_type = other RNA

SEQ ID NO: 10639 - RNA, 4269 nt, synthetic construct
  misc_feature 1..4269: note = Cpf1 variant mRNA product
  source 1..4269: mol_type = other RNA
gggagagcggctcggccattttgtcccagtcagtccggaggctgcggctgcagaagtaccgcctgcggagtaactgcaaagaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10640 - RNA, 4248 nt, synthetic construct
  misc_feature 1..4248: note = Cpf1 variant mRNA product
  source 1..4248: mol_type = other RNA
gggagagcggctcggccattttgtcccagtcagtccggaggctgcggctgcagaagtaccgcctgcggagtaactgcaaagaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10641 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10642 - RNA, 4190 nt, synthetic construct
  misc_feature 1..4190: note = Cpf1 variant mRNA product
  source 1..4190: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10643 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10644 - RNA, 4190 nt, synthetic construct
  misc_feature 1..4190: note = Cpf1 variant mRNA product
  source 1..4190: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10645 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10646 - RNA, 4190 nt, synthetic construct
  misc_feature 1..4190: note = Cpf1 variant mRNA product
  source 1..4190: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10647 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10648 - RNA, 4190 nt, synthetic construct
  misc_feature 1..4190: note = Cpf1 variant mRNA product
  source 1..4190: mol_type = other RNA
gggagagtccgctcagccaggttgcagaagcggcttagcgtgtgtcctaatcttctctctgcgtgtaggtaggcctgtgccgcaaacaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10649 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10650 - RNA, 4190 nt, synthetic construct
  misc_feature 1..4190: note = Cpf1 variant mRNA product
  source 1..4190: mol_type = other RNA
gggagagtccgctcagccaggttgcagaagcggcttagcgtgtgtcctaatcttctctctgcgtgtaggtaggcctgtgccgcaaacaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10651 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10652 - RNA, 4190 nt, synthetic construct; identical to SEQ ID NO: 10642
  misc_feature 1..4190: note = Cpf1 variant mRNA product
  source 1..4190: mol_type = other RNA

SEQ ID NO: 10653 - RNA, 4211 nt, synthetic construct
  misc_feature 1..4211: note = Cpf1 variant mRNA product
  source 1..4211: mol_type = other RNA
gggagagtccgctcagccaggttgcagaagcggcttagcgtgtgtcctaatcttctctctgcgtgtaggtaggcctgtgccgcaaacaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10654 - RNA, 4190 nt, synthetic construct
  misc_feature 1..4190: note = Cpf1 variant mRNA product
  source 1..4190: mol_type = other RNA
gggagagtccgctcagccaggttgcagaagcggcttagcgtgtgtcctaatcttctctctgcgtgtaggtaggcctgtgccgcaaacaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10655 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10656 - RNA, 4171 nt, synthetic construct
  misc_feature 1..4171: note = Cpf1 variant mRNA product
  source 1..4171: mol_type = other RNA
gggagagtcccgcagtcggcgtccagcggctctgcttgttcgtgtgtgtgtcgttgcaggccttattcaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10657 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10658 - RNA, 4171 nt, synthetic construct
  misc_feature 1..4171: note = Cpf1 variant mRNA product
  source 1..4171: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10659 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10660 - RNA, 4171 nt, synthetic construct
  misc_feature 1..4171: note = Cpf1 variant mRNA product
  source 1..4171: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10661 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10662 - RNA, 4171 nt, synthetic construct
  misc_feature 1..4171: note = Cpf1 variant mRNA product
  source 1..4171: mol_type = other RNA
gggagagtcccgcagtcggcgtccagcggctctgcttgttcgtgtgtgtgtcgttgcaggccttattcaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10663 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10664 - RNA, 4171 nt, synthetic construct
  misc_feature 1..4171: note = Cpf1 variant mRNA product
  source 1..4171: mol_type = other RNA
gggagagtcccgcagtcggcgtccagcggctctgcttgttcgtgtgtgtgtcgttgcaggccttattcaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10665 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10666 - RNA, 4171 nt, synthetic construct; identical to SEQ ID NO: 10656
  misc_feature 1..4171: note = Cpf1 variant mRNA product
  source 1..4171: mol_type = other RNA

SEQ ID NO: 10667 - RNA, 4192 nt, synthetic construct
  misc_feature 1..4192: note = Cpf1 variant mRNA product
  source 1..4192: mol_type = other RNA
gggagagtcccgcagtcggcgtccagcggctctgcttgttcgtgtgtgtgtcgttgcaggccttattcaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10668 - RNA, 4171 nt, synthetic construct
  misc_feature 1..4171: note = Cpf1 variant mRNA product
  source 1..4171: mol_type = other RNA
gggagagtcccgcagtcggcgtccagcggctctgcttgttcgtgtgtgtgtcgttgcaggccttattcaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10669 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10670 - RNA, 4281 nt, synthetic construct
  misc_feature 1..4281: note = Cpf1 variant mRNA product
  source 1..4281: mol_type = other RNA
gggagaggcgctgcctacggaggtggcagccatctccttctcggcatcaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10671 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10672 - RNA, 4281 nt, synthetic construct
  misc_feature 1..4281: note = Cpf1 variant mRNA product
  source 1..4281: mol_type = other RNA
gggagaggcgctgcctacggaggtggcagccatctccttctcggcatcaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10673 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10674 - RNA, 4281 nt, synthetic construct
  misc_feature 1..4281: note = Cpf1 variant mRNA product
  source 1..4281: mol_type = other RNA
gggagaggcgctgcctacggaggtggcagccatctccttctcggcatcaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10675 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10676 - RNA, 4281 nt, synthetic construct
  misc_feature 1..4281: note = Cpf1 variant mRNA product
  source 1..4281: mol_type = other RNA
gggagaggcgctgcctacggaggtggcagccatctccttctcggcatcaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10677 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10678 - RNA, 4281 nt, synthetic construct
  misc_feature 1..4281: note = Cpf1 variant mRNA product
  source 1..4281: mol_type = other RNA
gggagaggcgctgcctacggaggtggcagccatctccttctcggcatcaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10679 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10680 - RNA, 4281 nt, synthetic construct; identical to SEQ ID NO: 10670
  misc_feature 1..4281: note = Cpf1 variant mRNA product
  source 1..4281: mol_type = other RNA

SEQ ID NO: 10681 - RNA, 4302 nt, synthetic construct
  misc_feature 1..4302: note = Cpf1 variant mRNA product
  source 1..4302: mol_type = other RNA
gggagaggcgctgcctacggaggtggcagccatctccttctcggcatcaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10682 - RNA, 4281 nt, synthetic construct
  misc_feature 1..4281: note = Cpf1 variant mRNA product
  source 1..4281: mol_type = other RNA
gggagaggcgctgcctacggaggtggcagccatctccttctcggcatcaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 10683 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10684 - RNA, 4333 nt, synthetic construct
  misc_feature 1..4333: note = Cpf1 variant mRNA product
  source 1..4333: mol_type = other RNA
ggggcgctgcctacggaggtggcagccatctccttctcggcatcaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10685 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10686 - RNA, 4333 nt, synthetic construct
  misc_feature 1..4333: note = Cpf1 variant mRNA product
  source 1..4333: mol_type = other RNA
ggggcgctgcctacggaggtggcagccatctccttctcggcatcaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10687 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10688 - RNA, 4333 nt, synthetic construct
  misc_feature 1..4333: note = Cpf1 variant mRNA product
  source 1..4333: mol_type = other RNA
ggggcgctgcctacggaggtggcagccatctccttctcggcatcaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10689 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10690 - RNA, 4333 nt, synthetic construct
  misc_feature 1..4333: note = Cpf1 variant mRNA product
  source 1..4333: mol_type = other RNA
ggggcgctgcctacggaggtggcagccatctccttctcggcatcaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10691 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10692 - RNA, 4333 nt, synthetic construct
  misc_feature 1..4333: note = Cpf1 variant mRNA product
  source 1..4333: mol_type = other RNA
ggggcgctgcctacggaggtggcagccatctccttctcggcatcaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10693 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10694 - RNA, 4333 nt, synthetic construct; identical to SEQ ID NO: 10684
  misc_feature 1..4333: note = Cpf1 variant mRNA product
  source 1..4333: mol_type = other RNA

SEQ ID NO: 10695 - RNA, 4354 nt, synthetic construct
  misc_feature 1..4354: note = Cpf1 variant mRNA product
  source 1..4354: mol_type = other RNA
ggggcgctgcctacggaggtggcagccatctccttctcggcatcaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10696 - RNA, 4333 nt, synthetic construct
  misc_feature 1..4333: note = Cpf1 variant mRNA product
  source 1..4333: mol_type = other RNA
ggggcgctgcctacggaggtggcagccatctccttctcggcatcaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 10697 - RNA, 4256 nt, synthetic construct
  misc_feature 1..4256: note = Cpf1 variant mRNA product
  source 1..4256: mol_type = other RNA
gggagagtcccgcagtcggcgtccagcggctctgcttgttcgtgtgtgtgtcgttgcaggccttattcaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10698 - RNA, 4235 nt, synthetic construct
  misc_feature 1..4235: note = Cpf1 variant mRNA product
  source 1..4235: mol_type = other RNA
gggagagtcccgcagtcggcgtccagcggctctgcttgttcgtgtgtgtgtcgttgcaggccttattcaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10699 - RNA, 4256 nt, synthetic construct
  misc_feature 1..4256: note = Cpf1 variant mRNA product
  source 1..4256: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10700 - RNA, 4235 nt, synthetic construct
  misc_feature 1..4235: note = Cpf1 variant mRNA product
  source 1..4235: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10701 - RNA, 4256 nt, synthetic construct
  misc_feature 1..4256: note = Cpf1 variant mRNA product
  source 1..4256: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10702 - RNA, 4235 nt, synthetic construct
  misc_feature 1..4235: note = Cpf1 variant mRNA product
  source 1..4235: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10703 - RNA, 4256 nt, synthetic construct
  misc_feature 1..4256: note = Cpf1 variant mRNA product
  source 1..4256: mol_type = other RNA
gggagagtcccgcagtcggcgtccagcggctctgcttgttcgtgtgtgtgtcgttgcaggccttattcaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10704 - RNA, 4235 nt, synthetic construct
  misc_feature 1..4235: note = Cpf1 variant mRNA product
  source 1..4235: mol_type = other RNA
gggagagtcccgcagtcggcgtccagcggctctgcttgttcgtgtgtgtgtcgttgcaggccttattcaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10705 - RNA, 4256 nt, synthetic construct
  misc_feature 1..4256: note = Cpf1 variant mRNA product
  source 1..4256: mol_type = other RNA
gggagagtcccgcagtcggcgtccagcggctctgcttgttcgtgtgtgtgtcgttgcaggccttattcaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10706 - RNA, 4235 nt, synthetic construct
  misc_feature 1..4235: note = Cpf1 variant mRNA product
  source 1..4235: mol_type = other RNA
gggagagtcccgcagtcggcgtccagcggctctgcttgttcgtgtgtgtgtcgttgcaggccttattcaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10707 - RNA, 4256 nt, synthetic construct
  misc_feature 1..4256: note = Cpf1 variant mRNA product
  source 1..4256: mol_type = other RNA
gggagagtcccgcagtcggcgtccagcggctctgcttgttcgtgtgtgtgtcgttgcaggccttattcaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10708 - RNA, 4235 nt, synthetic construct; identical to SEQ ID NO: 10698
  misc_feature 1..4235: note = Cpf1 variant mRNA product
  source 1..4235: mol_type = other RNA

SEQ ID NO: 10709 - RNA, 4256 nt, synthetic construct
  misc_feature 1..4256: note = Cpf1 variant mRNA product
  source 1..4256: mol_type = other RNA
gggagagtcccgcagtcggcgtccagcggctctgcttgttcgtgtgtgtgtcgttgcaggccttattcaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10710 - RNA, 4235 nt, synthetic construct
  misc_feature 1..4235: note = Cpf1 variant mRNA product
  source 1..4235: mol_type = other RNA
gggagagtcccgcagtcggcgtccagcggctctgcttgttcgtgtgtgtgtcgttgcaggccttattcaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10711 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10712 - RNA, 4332 nt, synthetic construct
  misc_feature 1..4332: note = Cpf1 variant mRNA product
  source 1..4332: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10713 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10714 - RNA, 4332 nt, synthetic construct
  misc_feature 1..4332: note = Cpf1 variant mRNA product
  source 1..4332: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10715 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10716 - RNA, 4332 nt, synthetic construct
  misc_feature 1..4332: note = Cpf1 variant mRNA product
  source 1..4332: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10717 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10718 - RNA, 4332 nt, synthetic construct
  misc_feature 1..4332: note = Cpf1 variant mRNA product
  source 1..4332: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10719 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10720 - RNA, 4332 nt, synthetic construct
  misc_feature 1..4332: note = Cpf1 variant mRNA product
  source 1..4332: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10721 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10722 - RNA, 4332 nt, synthetic construct; identical to SEQ ID NO: 10712
  misc_feature 1..4332: note = Cpf1 variant mRNA product
  source 1..4332: mol_type = other RNA

SEQ ID NO: 10723 - RNA, 4353 nt, synthetic construct
  misc_feature 1..4353: note = Cpf1 variant mRNA product
  source 1..4353: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10724 - RNA, 4332 nt, synthetic construct
  misc_feature 1..4332: note = Cpf1 variant mRNA product
  source 1..4332: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 10725 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10726 - RNA, 4268 nt, synthetic construct
  misc_feature 1..4268: note = Cpf1 variant mRNA product
  source 1..4268: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10727 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10728 - RNA, 4268 nt, synthetic construct
  misc_feature 1..4268: note = Cpf1 variant mRNA product
  source 1..4268: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10729 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10730 - RNA, 4268 nt, synthetic construct
  misc_feature 1..4268: note = Cpf1 variant mRNA product
  source 1..4268: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10731 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10732 - RNA, 4268 nt, synthetic construct
  misc_feature 1..4268: note = Cpf1 variant mRNA product
  source 1..4268: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10733 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10734 - RNA, 4268 nt, synthetic construct
  misc_feature 1..4268: note = Cpf1 variant mRNA product
  source 1..4268: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10735 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10736 - RNA, 4268 nt, synthetic construct; identical to SEQ ID NO: 10726
  misc_feature 1..4268: note = Cpf1 variant mRNA product
  source 1..4268: mol_type = other RNA

SEQ ID NO: 10737 - RNA, 4289 nt, synthetic construct
  misc_feature 1..4289: note = Cpf1 variant mRNA product
  source 1..4289: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10738 - RNA, 4268 nt, synthetic construct
  misc_feature 1..4268: note = Cpf1 variant mRNA product
  source 1..4268: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10739 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10740 - RNA, 4217 nt, synthetic construct
  misc_feature 1..4217: note = Cpf1 variant mRNA product
  source 1..4217: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10741 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10742 - RNA, 4217 nt, synthetic construct
  misc_feature 1..4217: note = Cpf1 variant mRNA product
  source 1..4217: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10743 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10744 - RNA, 4217 nt, synthetic construct
  misc_feature 1..4217: note = Cpf1 variant mRNA product
  source 1..4217: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10745 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10746 - RNA, 4217 nt, synthetic construct
  misc_feature 1..4217: note = Cpf1 variant mRNA product
  source 1..4217: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10747 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10748 - RNA, 4217 nt, synthetic construct
  misc_feature 1..4217: note = Cpf1 variant mRNA product
  source 1..4217: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10749 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10750 - RNA, 4217 nt, synthetic construct; identical to SEQ ID NO: 10740
  misc_feature 1..4217: note = Cpf1 variant mRNA product
  source 1..4217: mol_type = other RNA

SEQ ID NO: 10751 - RNA, 4238 nt, synthetic construct
  misc_feature 1..4238: note = Cpf1 variant mRNA product
  source 1..4238: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10752 - RNA, 4217 nt, synthetic construct
  misc_feature 1..4217: note = Cpf1 variant mRNA product
  source 1..4217: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 10753 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10754 - RNA, 4203 nt, synthetic construct
  misc_feature 1..4203: note = Cpf1 variant mRNA product
  source 1..4203: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10755 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10756 - RNA, 4203 nt, synthetic construct
  misc_feature 1..4203: note = Cpf1 variant mRNA product
  source 1..4203: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10757 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10758 - RNA, 4203 nt, synthetic construct
  misc_feature 1..4203: note = Cpf1 variant mRNA product
  source 1..4203: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10759 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10760 - RNA, 4203 nt, synthetic construct
  misc_feature 1..4203: note = Cpf1 variant mRNA product
  source 1..4203: mol_type = other RNA
gggagagtccgctcagccaggttgcagaagcggcttagcgtgtgtcctaatcttctctctgcgtgtaggtaggcctgtgccgcaaacaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10761 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10762 - RNA, 4203 nt, synthetic construct
  misc_feature 1..4203: note = Cpf1 variant mRNA product
  source 1..4203: mol_type = other RNA
gggagagtccgctcagccaggttgcagaagcggcttagcgtgtgtcctaatcttctctctgcgtgtaggtaggcctgtgccgcaaacaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10763 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10764 - RNA, 4203 nt, synthetic construct; identical to SEQ ID NO: 10754
  misc_feature 1..4203: note = Cpf1 variant mRNA product
  source 1..4203: mol_type = other RNA

SEQ ID NO: 10765 - RNA, 4224 nt, synthetic construct
  misc_feature 1..4224: note = Cpf1 variant mRNA product
  source 1..4224: mol_type = other RNA
gggagagtccgctcagccaggttgcagaagcggcttagcgtgtgtcctaatcttctctctgcgtgtaggtaggcctgtgccgcaaacaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10766 - RNA, 4203 nt, synthetic construct
  misc_feature 1..4203: note = Cpf1 variant mRNA product
  source 1..4203: mol_type = other RNA
gggagagtccgctcagccaggttgcagaagcggcttagcgtgtgtcctaatcttctctctgcgtgtaggtaggcctgtgccgcaaacaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10767 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10768 - RNA, 4184 nt, synthetic construct
  misc_feature 1..4184: note = Cpf1 variant mRNA product
  source 1..4184: mol_type = other RNA
gggagagtcccgcagtcggcgtccagcggctctgcttgttcgtgtgtgtgtcgttgcaggccttattcaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10769 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10770 - RNA, 4184 nt, synthetic construct
  misc_feature 1..4184: note = Cpf1 variant mRNA product
  source 1..4184: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10771 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10772 - RNA, 4184 nt, synthetic construct
  misc_feature 1..4184: note = Cpf1 variant mRNA product
  source 1..4184: mol_type = other RNA
gggagagtcccgcagtcggcgtccagcggctctgcttgttcgtgtgtgtgtcgttgcaggccttattcaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10773 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10774 - RNA, 4184 nt, synthetic construct
  misc_feature 1..4184: note = Cpf1 variant mRNA product
  source 1..4184: mol_type = other RNA
gggagagtcccgcagtcggcgtccagcggctctgcttgttcgtgtgtgtgtcgttgcaggccttattcaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10775 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10776 - RNA, 4184 nt, synthetic construct
  misc_feature 1..4184: note = Cpf1 variant mRNA product
  source 1..4184: mol_type = other RNA
gggagagtcccgcagtcggcgtccagcggctctgcttgttcgtgtgtgtgtcgttgcaggccttattcaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10777 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10778 - RNA, 4184 nt, synthetic construct; identical to SEQ ID NO: 10768
  misc_feature 1..4184: note = Cpf1 variant mRNA product
  source 1..4184: mol_type = other RNA

SEQ ID NO: 10779 - RNA, 4205 nt, synthetic construct
  misc_feature 1..4205: note = Cpf1 variant mRNA product
  source 1..4205: mol_type = other RNA
gggagagtcccgcagtcggcgtccagcggctctgcttgttcgtgtgtgtgtcgttgcaggccttattcaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10780 - RNA, 4184 nt, synthetic construct
  misc_feature 1..4184: note = Cpf1 variant mRNA product
  source 1..4184: mol_type = other RNA
gggagagtcccgcagtcggcgtccagcggctctgcttgttcgtgtgtgtgtcgttgcaggccttattcaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10781 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10782 - RNA, 4480 nt, synthetic construct
  misc_feature 1..4480: note = Cpf1 variant mRNA product
  source 1..4480: mol_type = other RNA
gggagagcggctcggccattttgtcccagtcagtccggaggctgcggctgcagaagtaccgcctgcggagtaactgcaaagaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10783 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10784 - RNA, 4480 nt, synthetic construct
  misc_feature 1..4480: note = Cpf1 variant mRNA product
  source 1..4480: mol_type = other RNA
gggagagcggctcggccattttgtcccagtcagtccggaggctgcggctgcagaagtaccgcctgcggagtaactgcaaagaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10785 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10786 - RNA, 4480 nt, synthetic construct
  misc_feature 1..4480: note = Cpf1 variant mRNA product
  source 1..4480: mol_type = other RNA
gggagagcggctcggccattttgtcccagtcagtccggaggctgcggctgcagaagtaccgcctgcggagtaactgcaaagaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10787 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10788 - RNA, 4480 nt, synthetic construct
  misc_feature 1..4480: note = Cpf1 variant mRNA product
  source 1..4480: mol_type = other RNA
gggagagcggctcggccattttgtcccagtcagtccggaggctgcggctgcagaagtaccgcctgcggagtaactgcaaagaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10789 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10790 - RNA, 4480 nt, synthetic construct
  misc_feature 1..4480: note = Cpf1 variant mRNA product
  source 1..4480: mol_type = other RNA
gggagagcggctcggccattttgtcccagtcagtccggaggctgcggctgcagaagtaccgcctgcggagtaactgcaaagaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10791 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10792 - RNA, 4480 nt, synthetic construct; identical to SEQ ID NO: 10782
  misc_feature 1..4480: note = Cpf1 variant mRNA product
  source 1..4480: mol_type = other RNA

SEQ ID NO: 10793 - RNA, 4501 nt, synthetic construct
  misc_feature 1..4501: note = Cpf1 variant mRNA product
  source 1..4501: mol_type = other RNA
gggagagcggctcggccattttgtcccagtcagtccggaggctgcggctgcagaagtaccgcctgcggagtaactgcaaagaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10794 - RNA, 4480 nt, synthetic construct
  misc_feature 1..4480: note = Cpf1 variant mRNA product
  source 1..4480: mol_type = other RNA
gggagagcggctcggccattttgtcccagtcagtccggaggctgcggctgcagaagtaccgcctgcggagtaactgcaaagaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10795 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10796 - RNA, 4270 nt, synthetic construct
  misc_feature 1..4270: note = Cpf1 variant mRNA product
  source 1..4270: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10797 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10798 - RNA, 4270 nt, synthetic construct
  misc_feature 1..4270: note = Cpf1 variant mRNA product
  source 1..4270: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10799 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10800 - RNA, 4270 nt, synthetic construct
  misc_feature 1..4270: note = Cpf1 variant mRNA product
  source 1..4270: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10801 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10802 - RNA, 4270 nt, synthetic construct
  misc_feature 1..4270: note = Cpf1 variant mRNA product
  source 1..4270: mol_type = other RNA
gggagagtccgctcagccaggttgcagaagcggcttagcgtgtgtcctaatcttctctctgcgtgtaggtaggcctgtgccgcaaacaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10803 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10804 - RNA, 4270 nt, synthetic construct
  misc_feature 1..4270: note = Cpf1 variant mRNA product
  source 1..4270: mol_type = other RNA
gggagagtccgctcagccaggttgcagaagcggcttagcgtgtgtcctaatcttctctctgcgtgtaggtaggcctgtgccgcaaacaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10805 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10806 - RNA, 4270 nt, synthetic construct; identical to SEQ ID NO: 10796
  misc_feature 1..4270: note = Cpf1 variant mRNA product
  source 1..4270: mol_type = other RNA

SEQ ID NO: 10807 - RNA, 4291 nt, synthetic construct
  misc_feature 1..4291: note = Cpf1 variant mRNA product
  source 1..4291: mol_type = other RNA
gggagagtccgctcagccaggttgcagaagcggcttagcgtgtgtcctaatcttctctctgcgtgtaggtaggcctgtgccgcaaacaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10808 - RNA, 4270 nt, synthetic construct
  misc_feature 1..4270: note = Cpf1 variant mRNA product
  source 1..4270: mol_type = other RNA
gggagagtccgctcagccaggttgcagaagcggcttagcgtgtgtcctaatcttctctctgcgtgtaggtaggcctgtgccgcaaacaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaagaatt

SEQ ID NO: 10809 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10810 - RNA, 4486 nt, synthetic construct
  misc_feature 1..4486: note = Cpf1 variant mRNA product
  source 1..4486: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10811 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10812 - RNA, 4486 nt, synthetic construct
  misc_feature 1..4486: note = Cpf1 variant mRNA product
  source 1..4486: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10813 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10814 - RNA, 4486 nt, synthetic construct
  misc_feature 1..4486: note = Cpf1 variant mRNA product
  source 1..4486: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10815 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10816 - RNA, 4486 nt, synthetic construct
  misc_feature 1..4486: note = Cpf1 variant mRNA product
  source 1..4486: mol_type = other RNA
gggagagtccgctcagccaggttgcagaagcggcttagcgtgtgtcctaatcttctctctgcgtgtaggtaggcctgtgccgcaaacaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10817 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10818 - RNA, 4486 nt, synthetic construct
  misc_feature 1..4486: note = Cpf1 variant mRNA product
  source 1..4486: mol_type = other RNA
gggagagtccgctcagccaggttgcagaagcggcttagcgtgtgtcctaatcttctctctgcgtgtaggtaggcctgtgccgcaaacaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10819 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10820 - RNA, 4486 nt, synthetic construct; identical to SEQ ID NO: 10810
  misc_feature 1..4486: note = Cpf1 variant mRNA product
  source 1..4486: mol_type = other RNA

SEQ ID NO: 10821 - RNA, 4507 nt, synthetic construct
  misc_feature 1..4507: note = Cpf1 variant mRNA product
  source 1..4507: mol_type = other RNA
gggagagtccgctcagccaggttgcagaagcggcttagcgtgtgtcctaatcttctctctgcgtgtaggtaggcctgtgccgcaaacaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10822 - RNA, 4486 nt, synthetic construct
  misc_feature 1..4486: note = Cpf1 variant mRNA product
  source 1..4486: mol_type = other RNA
gggagagtccgctcagccaggttgcagaagcggcttagcgtgtgtcctaatcttctctctgcgtgtaggtaggcctgtgccgcaaacaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10823 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10824 - RNA, 4266 nt, synthetic construct
  misc_feature 1..4266: note = Cpf1 variant mRNA product
  source 1..4266: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10825 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10826 - RNA, 4266 nt, synthetic construct
  misc_feature 1..4266: note = Cpf1 variant mRNA product
  source 1..4266: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10827 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10828 - RNA, 4266 nt, synthetic construct
  misc_feature 1..4266: note = Cpf1 variant mRNA product
  source 1..4266: mol_type = other RNA
gggagagtccgctcagccaggttgcagaagcggcttagcgtgtgtcctaatcttctctctgcgtgtaggtaggcctgtgccgcaaacaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10829 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10830 - RNA, 4266 nt, synthetic construct
  misc_feature 1..4266: note = Cpf1 variant mRNA product
  source 1..4266: mol_type = other RNA
gggagagtccgctcagccaggttgcagaagcggcttagcgtgtgtcctaatcttctctctgcgtgtaggtaggcctgtgccgcaaacaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10831 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10832 - RNA, 4266 nt, synthetic construct
  misc_feature 1..4266: note = Cpf1 variant mRNA product
  source 1..4266: mol_type = other RNA
gggagagtccgctcagccaggttgcagaagcggcttagcgtgtgtcctaatcttctctctgcgtgtaggtaggcctgtgccgcaaacaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10833 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10834 - RNA, 4266 nt, synthetic construct; identical to SEQ ID NO: 10824
  misc_feature 1..4266: note = Cpf1 variant mRNA product
  source 1..4266: mol_type = other RNA

SEQ ID NO: 10835 - RNA, 4287 nt, synthetic construct
  misc_feature 1..4287: note = Cpf1 variant mRNA product
  source 1..4287: mol_type = other RNA
gggagagtccgctcagccaggttgcagaagcggcttagcgtgtgtcctaatcttctctctgcgtgtaggtaggcctgtgccgcaaacaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10836 - RNA, 4266 nt, synthetic construct
  misc_feature 1..4266: note = Cpf1 variant mRNA product
  source 1..4266: mol_type = other RNA
gggagagtccgctcagccaggttgcagaagcggcttagcgtgtgtcctaatcttctctctgcgtgtaggtaggcctgtgccgcaaacaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10837 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10838 - RNA, 4293 nt, synthetic construct
  misc_feature 1..4293: note = Cpf1 variant mRNA product
  source 1..4293: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10839 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10840 - RNA, 4293 nt, synthetic construct
  misc_feature 1..4293: note = Cpf1 variant mRNA product
  source 1..4293: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10841 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10842 - RNA, 4293 nt, synthetic construct
  misc_feature 1..4293: note = Cpf1 variant mRNA product
  source 1..4293: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10843 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10844 - RNA, 4293 nt, synthetic construct
  misc_feature 1..4293: note = Cpf1 variant mRNA product
  source 1..4293: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10845 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10846 - RNA, 4293 nt, synthetic construct
  misc_feature 1..4293: note = Cpf1 variant mRNA product
  source 1..4293: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10847 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10848 - RNA, 4293 nt, synthetic construct; identical to SEQ ID NO: 10838
  misc_feature 1..4293: note = Cpf1 variant mRNA product
  source 1..4293: mol_type = other RNA

SEQ ID NO: 10849 - RNA, 4314 nt, synthetic construct
  misc_feature 1..4314: note = Cpf1 variant mRNA product
  source 1..4314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10850 - RNA, 4293 nt, synthetic construct
  misc_feature 1..4293: note = Cpf1 variant mRNA product
  source 1..4293: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaagaatt

SEQ ID NO: 10851 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10852 - RNA, 4489 nt, synthetic construct
  misc_feature 1..4489: note = Cpf1 variant mRNA product
  source 1..4489: mol_type = other RNA
gggagacccgtgacccggaagttgtacggctacgcgactttccctcccacaaaccctcgcgcccttcctttcctacttgggcccggcagaaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10853 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10854 - RNA, 4489 nt, synthetic construct
  misc_feature 1..4489: note = Cpf1 variant mRNA product
  source 1..4489: mol_type = other RNA
gggagacccgtgacccggaagttgtacggctacgcgactttccctcccacaaaccctcgcgcccttcctttcctacttgggcccggcagaaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10855 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10856 - RNA, 4489 nt, synthetic construct
  misc_feature 1..4489: note = Cpf1 variant mRNA product
  source 1..4489: mol_type = other RNA
gggagacccgtgacccggaagttgtacggctacgcgactttccctcccacaaaccctcgcgcccttcctttcctacttgggcccggcagaaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10857 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10858 - RNA, 4489 nt, synthetic construct
  misc_feature 1..4489: note = Cpf1 variant mRNA product
  source 1..4489: mol_type = other RNA
gggagacccgtgacccggaagttgtacggctacgcgactttccctcccacaaaccctcgcgcccttcctttcctacttgggcccggcagaaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10859 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10860 - RNA, 4489 nt, synthetic construct
  misc_feature 1..4489: note = Cpf1 variant mRNA product
  source 1..4489: mol_type = other RNA
gggagacccgtgacccggaagttgtacggctacgcgactttccctcccacaaaccctcgcgcccttcctttcctacttgggcccggcagaaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10861 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10862 - RNA, 4489 nt, synthetic construct; identical to SEQ ID NO: 10852
  misc_feature 1..4489: note = Cpf1 variant mRNA product
  source 1..4489: mol_type = other RNA

SEQ ID NO: 10863 - RNA, 4510 nt, synthetic construct
  misc_feature 1..4510: note = Cpf1 variant mRNA product
  source 1..4510: mol_type = other RNA
gggagacccgtgacccggaagttgtacggctacgcgactttccctcccacaaaccctcgcgcccttcctttcctacttgggcccggcagaaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10864 - RNA, 4489 nt, synthetic construct
  misc_feature 1..4489: note = Cpf1 variant mRNA product
  source 1..4489: mol_type = other RNA
gggagacccgtgacccggaagttgtacggctacgcgactttccctcccacaaaccctcgcgcccttcctttcctacttgggcccggcagaaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 10865 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10866 - RNA, 4224 nt, synthetic construct
  misc_feature 1..4224: note = Cpf1 variant mRNA product
  source 1..4224: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10867 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10868 - RNA, 4224 nt, synthetic construct
  misc_feature 1..4224: note = Cpf1 variant mRNA product
  source 1..4224: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10869 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10870 - RNA, 4224 nt, synthetic construct
  misc_feature 1..4224: note = Cpf1 variant mRNA product
  source 1..4224: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10871 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10872 - RNA, 4224 nt, synthetic construct
  misc_feature 1..4224: note = Cpf1 variant mRNA product
  source 1..4224: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10873 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10874 - RNA, 4224 nt, synthetic construct
  misc_feature 1..4224: note = Cpf1 variant mRNA product
  source 1..4224: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10875 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10876 - RNA, 4224 nt, synthetic construct; identical to SEQ ID NO: 10866
  misc_feature 1..4224: note = Cpf1 variant mRNA product
  source 1..4224: mol_type = other RNA

SEQ ID NO: 10877 - RNA, 4245 nt, synthetic construct
  misc_feature 1..4245: note = Cpf1 variant mRNA product
  source 1..4245: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10878 - RNA, 4224 nt, synthetic construct
  misc_feature 1..4224: note = Cpf1 variant mRNA product
  source 1..4224: mol_type = other RNA
gggagaatataagcgttggcggagcgtcggttgtagcactctgcgcgcccgctcttctgctgctgtttgtctacttcctcctgcttccccgccgccgccgccgccatcaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10879 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacccagttcgagggcttcaccaacctgtaccaggtgagcaagacgctccgcttcgagctgatcccccaggggaagaccctgaagcacatccaggagcagggcttcatcgaggaggacaaggcccggaacgaccactacaaggagctcaagccgatcatcgaccgcatctacaagacctacgccgaccagtgcctgcagctggtccagctcgactgggagaacctgtccgcggccatcgacagctaccggaaggagaagaccgaggagacgcgcaacgccctgatcgaggagcaggccacctaccggaacgccatccacgactacttcatcgggcgcaccgacaacctcaccgacgcgatcaacaagcggcacgccgagatctacaagggcctgttcaaggccgagctgttcaacgggaaggtgctcaagcagctgggcacggtgaccaccaccgagcacgagaacgccctgctccgctccttcgacaagttcacgacctacttcagcggcttctacgagaaccggaagaacgtcttctccgcggaggacatcagcaccgccatcccccaccgcatcgtgcaggacaacttccccaagttcaaggagaactgccacatcttcacccggctgatcacggccgtgccctccctgcgcgagcacttcgagaacgtcaagaaggccatcgggatcttcgtgagcacctccatcgaggaggtgttcagcttcccgttctacaaccagctcctgacccagacccagatcgacctgtacaaccagctcctgggcgggatctcccgggaggccggcacggagaagatcaaggggctgaacgaggtcctcaacctggcgatccagaagaacgacgagaccgcccacatcatcgccagcctgccccaccgcttcatccccctcttcaagcagatcctgtccgaccggaacaccctgagcttcatcctcgaggagttcaagtccgacgaggaggtgatccagagcttctgcaagtacaagaccctgctgcgcaacgagaacgtgctcgagacggccgaggccctgttcaacgagctgaactccatcgacctcacccacatcttcatcagccacaagaagctggagaccatctccagcgcgctgtgcgaccactgggacaccctccggaacgccctgtacgagcgccggatcagcgagctgacgggcaagatcaccaagtccgccaaggagaaggtccagcgcagcctcaagcacgaggacatcaacctgcaggagatcatctccgccgccggcaaggagctgagcgaggcgttcaagcagaagacctccgagatcctcagccacgcccacgccgccctggaccagcccctgccgaccacgctcaagaagcaggaggagaaggagatcctgaagtcccagctggacagcctgctcgggctgtaccacctcctcgactggttcgccgtggacgagtccaacgaggtggaccccgagttcagcgcgcggctgaccggcatcaagctggagatggagccctccctcagcttctacaacaaggcccgcaactacgccaccaagaagccctactccgtcgagaagttcaagctgaacttccagatgccgaccctggccagcgggtgggacgtgaacaaggagaagaacaacggcgcgatcctcttcgtgaagaacggcctgtactacctggggatcatgcccaagcagaagggccgctacaaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaaccccgagaaggagccgaagaagttccagaccgcctacgccaagaagacgggcgaccagaaggggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagcttccagcgcatcgcggagaaggagatcatggacgccgtggagaccggcaagctgtacctcttccagatctacaacaaggacttcgccaaggggcaccacggcaagcccaacctgcacaccctgtactggaccggcctcttctccccggagaacctggccaagacgagcatcaagctgaacgggcaggccgagctgttctaccggcccaagtcccgcatgaagcggatggcgcaccgcctgggggagaagatgctgaacaagaagctcaaggaccagaagacccccatccccgacaccctgtaccaggagctgtacgactacgtgaaccaccggctcagccacgacctgtccgacgaggcccgcgccctgctcccgaacgtcatcaccaaggaggtgagccacgagatcatcaaggaccggcgcttcacgtccgacaagttcttcttccacgtgcccatcaccctgaactaccaggccgcgaacagcccctccaagttcaaccagcgggtcaacgcctacctgaaggagcacccggagacccccatcatcggcatcgaccgcggcgagcggaacctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcaggggtacctgtcccaggtcatccacgagatcgtggacctcatgatccactaccaggcggtggtcgtgctggagaacctgaacttcggcttcaagagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcgccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgccaaggggacgcccttcatcgccggcaagcggatcgtgcccgtcatcgagaaccaccgcttcaccgggcggtaccgcgacctgtacccggccaacgagctgatcgcgctcctggaggagaagggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggccagctcctgctgaaccacctcaaggagtccaaggacctgaagctgcagaacgggatcagcaaccaggactggctcgcgtacatccaggagctgcgcaacaagcggcccgccgccacgaagaaggccggccaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10880 - RNA, 4344 nt, synthetic construct
  misc_feature 1..4344: note = Cpf1 variant mRNA product
  source 1..4344: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcatctaccaggagttcgtgaacaagtactccctgagcaagaccctccgcttcgagctgatcccccagggcaagaccctggagaacatcaaggcccgggggctcatcctggacgacgagaagcgcgccaaggactacaagaaggcgaagcagatcatcgacaagtaccaccagttcttcatcgaggagatcctgtccagcgtctgcatctccgaggacctcctgcagaactacagcgacgtgtacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgccaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaaggggttccacgagaaccggaagaacgtgtactccagcaacgacatcccgacgtccatcatctaccgcatcgtcgacgacaacctgcccaagttcctcgagaacaaggcgaagtacgagagcctgaaggacaaggcccccgaggccatcaactacgagcagatcaagaaggacctggccgaggagctcaccttcgacatcgactacaagacctccgaggtgaaccagcgggtgttcagcctggacgaggtcttcgagatcgcgaacttcaacaactacctgaaccagagcggcatcaccaagttcaacacgatcatcggcgggaagttcgtgaacggcgagaacaccaagcgcaaggggatcaacgagtacatcaacctctactcccagcagatcaacgacaagaccctgaagaagtacaagatgagcgtgctgttcaagcagatcctctccgacaccgagagcaagtccttcgtcatcgacaagctggaggacgacagcgacgtggtgacgaccatgcagtccttctacgagcagatcgccgccttcaagaccgtcgaggagaagtccatcaaggagaccctgagcctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcgcccaagaacctggacaacccgagcaagaaggagcaggagctcatcgccaagaagaccgagaaggccaagtacctgtccctggagacgatcaagctcgccctggaggagttcaacaagcaccgggacatcgacaagcagtgccgcttcgaggagatcctggccaacttcgcggccatccccatgatcttcgacgagatcgcccagaacaaggacaacctcgcccagatcagcatcaagtaccagaaccaggggaagaaggacctgctgcaggcctccgcggaggacgacgtgaaggccatcaaggacctcctggaccagaccaacaacctgctgcacaagctcaagatcttccacatcagccagtccgaggacaaggccaacatcctggacaaggacgagcacttctacctggtgttcgaggagtgctacttcgagctcgccaacatcgtccccctgtacaacaagatccggaactacatcacccagaagccctacagcgacgagaagttcaagctgaacttcgagaacagcaccctcgccaacggctgggacaagaacaaggagccggacaacacggcgatcctgttcatcaaggacgacaagtactacctgggcgtgatgaacaagaagaacaacaagatcttcgacgacaaggccatcaaggagaacaagggggagggctacaagaagatcgtgtacaagctcctgcccggggccaacaagatgctgcccaaggtcttcttctccgccaagagcatcaagttctacaacccctccgaggacatcctccgcatccggaaccacagcacccacaccaagaacggctccccgcagaagggctacgagaagttcgagttcaacatcgaggactgccgcaagttcatcgacttctacaagcagagcatctccaagcaccccgagtggaaggacttcgggttccggttcagcgacacccagcgctacaactccatcgacgagttctaccgggaggtggagaaccagggctacaagctgacgttcgagaacatcagcgagtcctacatcgacagcgtggtcaaccaggggaagctgtacctcttccagatctacaacaaggacttctccgcgtacagcaagggccgccccaacctgcacaccctgtactggaaggccctcttcgacgagcggaacctgcaggacgtggtctacaagctgaacggggaggccgagctgttctaccgcaagcagtccatccccaagaagatcacccacccggccaaggaggccatcgcgaacaagaacaaggacaaccccaagaaggagagcgtgttcgagtacgacctcatcaaggacaagcggttcaccgaggacaagttcttcttccactgccccatcacgatcaacttcaagtccagcggcgccaacaagttcaacgacgagatcaacctgctcctgaaggagaaggccaacgacgtgcacatcctgagcatcgaccgcggcgagcggcacctcgcctactacaccctggtcgacgggaagggcaacatcatcaagcaggacaccttcaacatcatcgggaacgaccgcatgaagaccaactaccacgacaagctggccgcgatcgagaaggaccgcgactccgcccggaaggactggaagaagatcaacaacatcaaggagatgaaggagggctacctcagccaggtggtgcacgagatcgccaagctggtcatcgagtacaacgccatcgtggtgttcgaggacctgaacttcgggttcaagcgcggccggttcaaggtcgagaagcaggtctaccagaagctcgagaagatgctgatcgagaagctgaactacctcgtgttcaaggacaacgagttcgacaagacgggcggggtgctgcgcgcctaccagctgaccgcgcccttcgagaccttcaagaagatgggcaagcagaccgggatcatctactacgtgccggccggcttcacctccaagatctgccccgtgacggggttcgtcaaccagctctaccccaagtacgagagcgtgtccaagagccaggagttcttctccaagttcgacaagatctgctacaacctggacaagggctacttcgagttcagcttcgactacaagaacttcggcgacaaggccgccaaggggaagtggaccatcgcgtccttcggcagccggctgatcaacttccgcaactccgacaagaaccacaactgggacacccgggaggtgtaccccaccaaggagctcgagaagctgctgaaggactacagcatcgagtacgggcacggcgagtgcatcaaggccgccatctgcggcgagtccgacaagaagttcttcgccaagctcacgagcgtcctgaacaccatcctgcagatgcgcaactccaagaccgggaccgagctcgactacctgatcagcccggtggccgacgtgaacggcaacttcttcgactcccggcaggcgcccaagaacatgccccaggacgccgacgccaacggggcctaccacatcggcctgaaggggctcatgctgctgggccgcatcaagaacaaccaggagggcaagaagctcaacctggtcatcaagaacgaggagtacttcgagttcgtgcagaaccggaacaacaagcgccccgccgcgacgaagaaggccgggcaggccaagaagaagaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10881 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaacaagcggccggcggctactaaaaaggccggccaggcaaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10882 - RNA, 4344 nt, synthetic construct
  misc_feature 1..4344: note = Cpf1 variant mRNA product
  source 1..4344: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaagagctttaagggctggaccacatatttcaaagggtttcatgaaaatcgcaagaacgtgtactcctcaaatgatatccctacaagtattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaaactggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataacaagaggcccgccgcaactaaaaaggctgggcaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10883 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaacaagagacctgctgccaccaaaaaggccggccaggctaagaaaaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10884 - RNA, 4344 nt, synthetic construct
  misc_feature 1..4344: note = Cpf1 variant mRNA product
  source 1..4344: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaaaaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataacaagagaccggccgccacaaagaaggctggccaagccaaaaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10885 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacacaattcgaaggcttcaccaacctatatcaagttagtaaaacactacgtttcgaactaataccgcaaggaaaaaccttaaaacacatacaagaacaaggctttatagaagaagacaaagcacgaaacgatcactacaaagaactaaaaccgatcatagaccgtatctacaaaacctacgcagaccaatgtcttcagctagttcaacttgactgggaaaacctgagcgccgcaatagatagctatcgaaaagagaaaacagaagaaactagaaacgctttgatagaagaacaagctacatatagaaacgccatacatgactatttcataggaagaactgacaatcttacagacgccataaacaaaagacacgctgaaatatataaaggactatttaaagcagaactgttcaatggtaaagtactaaaacaactcggaacggttacaacaacagaacacgaaaatgctctacttaggtcctttgataaattcaccacatacttttctggattctatgaaaaccgtaaaaatgtcttttctgcagaagatatatcaacagcgattccacatagaatagttcaagataactttcccaaattcaaagaaaattgccacatcttcactcgtctaataacagcagttccaagtttacgtgaacactttgaaaacgtcaagaaagcaataggcatatttgttagtacaagcatagaagaagttttctcatttccattttacaatcagctcctaacacaaacccaaatagacctatacaaccaactattgggaggcataagcagagaagcaggcaccgagaaaataaaaggcctgaatgaagtactaaatctagcaattcagaaaaacgatgaaaccgcacacattatcgcttcattacctcaccgatttataccgctattcaaacaaatcttatccgacaggaatacactcagttttatattagaagaatttaaaagtgacgaagaagtcatacaatcattttgtaaatacaaaacactactacgaaacgaaaacgtcctagaaactgcagaagcactcttcaatgaattaaattctatcgacttaacacacatatttatatcacacaaaaagttagaaactatatcatcagctttatgtgatcactgggatacactcagaaatgcactgtacgaaagacgaatctctgaactcacaggtaaaattacaaaatccgccaaagaaaaagtacaaagatcactcaaacatgaagacattaaccttcaagaaataatttcagcagcaggaaaagagctttcagaggctttcaaacagaaaacttcagaaatattaagtcacgcacacgcagcccttgaccaacccttaccaactacccttaagaaacaagaagaaaaagaaatactgaaatcgcaattagactcactgctaggtctatatcatctattagactggttcgcagtagacgaatcaaatgaagtcgacccagagttctctgcacgactaaccggaattaaactggaaatggaaccgtcacttagtttttacaacaaagcacgaaactacgccactaagaaaccctattccgtcgaaaaatttaaacttaatttccaaatgcccacactcgcatcaggatgggatgtcaataaagagaaaaacaatggcgcaatactatttgtcaaaaacggactatactatctcggaataatgccaaaacaaaaaggtcgttacaaagcactctcatttgaacctacagagaaaacatcagaaggatttgacaaaatgtattatgactatttcccagacgcagcaaaaatgatacccaaatgttcaacacagttaaaagctgttacagcacattttcaaacacacactacccctatcctgctctcaaacaatttcatagaacccctggaaataaccaaagaaatatacgaccttaacaacccagaaaaagaaccaaagaaattccaaaccgcctacgccaagaaaacaggtgaccaaaaaggatatcgagaagcgctatgcaaatggatcgacttcacacgagacttcctatccaaatatacaaaaacaacctcaatagatttatcatctctaaggccctcttcacaatacaaagatttaggtgaatattatgcagaactaaatccacttctataccacatatcattccaacgcatagccgaaaaagaaataatggacgccgttgaaaccggcaaattgtaccttttccaaatatacaacaaagacttcgccaaaggacaccacgggaaaccaaacttacacacattatactggacaggactattctcaccagaaaatctagcaaaaacctcaataaaacttaacggccaagctgaacttttctacagaccaaaatcccgtatgaaacgaatggctcaccgcttaggtgagaaaatgctaaacaagaaattaaaagaccagaaaacacccataccagatactctatatcaggaattatatgactacgtaaatcataggctaagtcatgatttatctgatgaagccagagcccttctacccaatgttattactaaagaagtgagtcatgaaataataaaagataggagattcacatcagataaatttttcttccatgttccaatcactcttaactatcaagcagcaaacagcccttcaaagttcaatcaacgagtaaatgcctacctaaaagaacaccctgaaactccaataataggtatagacagaggggaaagaaacctcatttatatcacagtgatagattctacaggcaagatccttgaacagaggagtctaaacaccattcaacaatttgactaccagaagaaattagataatagggaaaaagaaagagtcgccgctcgacaagcatggtcagttgtaggtaccattaaagacttaaaacaaggatatctttcgcaagtaattcatgagatcgtagacctaatgattcactaccaagcagtagtcgtactagaaaatcttaactttggattcaaatccaaaagaacaggaatagctgaaaaagctgtatatcagcaattcgagaaaatgctaatcgacaaattgaactgcttagttttaaaagattatcctgcggaaaaagtaggaggcgtattaaatccatatcaactaaccgatcagtttacctcattcgcaaaaatgggaacacagtcaggcttccttttctatgtgcccgcaccatatacatcaaaaatagacccattaacaggttttgttgacccatttgtgtggaaaacaataaagaaccacgaatctagaaaacacttcttagaaggcttcgactttctgcactatgatgttaaaactggggacttcatacttcattttaagatgaaccgtaacttatcattccaacgaggactaccgggcttcatgccagcttgggacatagtctttgagaaaaacgaaactcaatttgacgctaaaggaactccctttattgcaggaaaaaggatagtcccagttatagaaaaccatagatttactggtcgttacagagatctatacccagcaaacgaattaatagcactactggaagaaaaaggaatagtattccgagatggcagcaacattctaccaaaacttctagaaaacgacgatagtcatgcaatagatacaatggtcgcactaatcagaagcgtcttacagatgagaaacagtaatgctgccactggagaagattatataaattcaccagtaagagacttgaatggcgtctgttttgactcaagattccaaaacccagaatggccaatggacgccgacgcgaacggcgcatatcacatcgctttaaaaggacaactactcttaaatcacctcaaagaatcaaaagatctaaaattacagaatggcatatctaaccaagactggttagcttacatacaagaactccgaaacaagaggccagcagcaacaaagaaggccggccaagctaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10886 - RNA, 4344 nt, synthetic construct
  misc_feature 1..4344: note = Cpf1 variant mRNA product
  source 1..4344: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcaatatatcaagaatttgtaaataaatactctctatcgaaaaccttgcgctttgaactaataccacaaggaaaaacattagaaaacatcaaagctaggggcttgatactagatgatgagaaaagggcaaaagattacaagaaagcaaaacaaataatagacaaataccaccaattcttcatagaagaaatactatcaagcgtatgcataagtgaagaccttcttcaaaattatagcgacgtatatttcaaactaaagaaatcagacgatgataacctccaaaaagactttaaaagtgcaaaagacacaatcaagaaacaaatatccgaatatatcaaagacagcgagaaatttaaaaatttattcaaccaaaatctaatagatgccaagaaagggcaagaaagcgacctaatcctatggctaaaacaaagcaaagataatggaatcgaattatttaaagcaaactcagacataactgacatagacgaagcattagaaataataaaatcatttaaaggatggaccacctactttaaaggatttcacgaaaacaggaaaaacgtatatagcagtaacgacataccaacctcaataatataccgcatagtagacgataatcttccaaaatttcttgaaaacaaagcaaaatatgaatctctcaaagataaagcaccagaagccattaattatgaacagatcaagaaagacctagctgaagaactaacatttgatatcgattataaaacctcagaagttaaccaaagagtatttagtctagacgaagtattcgaaatagctaattttaacaactaccttaatcaatccggaataacaaaattcaacacaatcataggcggcaaattcgtaaacggcgaaaacacaaaaagaaaaggaataaacgaatacatcaacctatatagccagcaaataaacgacaaaacattaaagaaatataaaatgtctgtactttttaaacaaatcctttccgacactgaatctaaaagttttgtaatagataaacttgaagacgacagcgacgtagtcaccacaatgcagagcttttatgaacaaatcgcggctttcaaaacggtcgaagaaaaatccataaaagaaaccttatcacttttgttcgatgatttaaaagcacaaaaattagacctcagtaaaatatactttaaaaatgacaaatccctcactgatctctcacaacaggtattcgacgattattctgtaataggaaccgcagtactcgaatacataacacagcaaatagcccctaaaaatctagacaatccaagtaagaaagaacaagaactgatcgctaagaaaaccgaaaaagcaaaatacttatcacttgaaacaataaaattggcactggaagaatttaacaaacaccgcgacattgacaaacaatgtagattcgaggaaatcctagccaacttcgctgccatccctatgatattcgatgaaatagcacaaaacaaagacaacctagcacaaatatccataaaatatcagaaccaaggcaaaaaggatctattacaagcatcagccgaggatgacgtaaaagccataaaagaccttctcgaccaaacgaataatttactacataaactaaaaatattccacatctcacagtctgaagataaagcaaatatactcgataaagatgaacacttctatctcgtattcgaagaatgctacttcgaactagcaaatattgttccattatacaacaaaattaggaactacattactcaaaaaccatactccgacgaaaaattcaaactaaatttcgaaaattctacactcgcaaatggatgggacaaaaataaagaacccgacaataccgcaatattattcattaaagatgataaatattacctaggagtaatgaataagaaaaacaacaaaatcttcgatgacaaagctataaaagaaaacaaaggagaaggatacaagaaaatagtctataaattactacccggagcaaacaaaatgttaccaaaagtatttttcagcgccaaaagcataaaattctacaatccatccgaagatatactaagaatacgaaaccattcaacacataccaaaaacggttctccacaaaaaggttatgaaaaatttgagttcaatatcgaagactgtagaaagtttatcgatttttacaaacaaagcatatcaaaacacccagagtggaaagactttggatttcgcttctccgacacacagcgctataactccattgatgagttctaccgcgaagtagaaaaccaaggatacaaactcacatttgaaaacatttcagaatcctatattgattccgtagttaatcaaggaaaattatacttattccaaatatataacaaagattttagcgcatacagtaaaggccgaccgaatttacatacactttactggaaagcattattcgatgaaagaaacttacaagatgtagtatacaaattaaatggagaagcagaactcttctatagaaaacaatccattcccaagaaaataactcatccagcaaaagaagcgatagcaaataaaaataaagacaacccgaagaaagaatctgtatttgaatatgatctaataaaagacaaaagattcacagaggacaaattcttctttcactgtcctataacaataaatttcaaatcttccggagcaaacaaatttaacgatgaaataaatctattactcaaagaaaaagctaatgatgttcatattctgagtatcgacagaggtgaaagacatttggcatattataccctagtagacggaaaaggaaacataataaaacaagatacatttaacatcataggaaacgaccgaatgaaaacaaactatcacgacaaattagcagccatcgaaaaagacagagactcagcaagaaaagactggaagaaaataaataacataaaagaaatgaaagagggatacttatcacaagttgtccacgaaatcgcgaaactggtcatagaatacaatgcaatagtcgtctttgaggacttaaattttggatttaaacgaggaagattcaaagtagaaaaacaagtataccaaaaacttgagaaaatgctaatagaaaaactaaactacttagtattcaaagacaatgagttcgacaaaaccggaggcgtactgagggcatatcaactaaccgcaccattcgaaacgtttaaaaagatgggaaaacaaacaggaataatatactacgtacccgctggtttcacatcaaaaatctgccctgtgaccggatttgtcaaccaactgtacccaaaatacgagtccgtatccaaaagtcaagagttcttcagcaaattcgacaaaatttgctacaacctagacaaaggctatttcgagttttcgttcgattacaaaaattttggtgataaagcagcaaaaggcaaatggacaattgcatctttcggaagtcgcttaatcaacttcagaaactcggataaaaaccataattgggatacccgcgaagtctacccaactaaagaattagaaaaactcctaaaagattacagcatagaatacggacacggagaatgcataaaagcagccatctgcggcgaatcagacaagaaatttttcgctaaactgacatccgtactaaacactatattacaaatgcgcaatagcaaaacaggaacggaacttgactatcttatttccccagtagctgacgtaaacggcaactttttcgactctcgacaagcaccgaaaaacatgccccaagacgcagacgccaatggggcataccatattggactgaaaggactaatgctattaggtcgaatcaaaaataatcaagaaggcaagaaactaaatctggtaatcaaaaatgaagaatatttcgaatttgtccaaaaccgaaataataagcgaccagctgcaactaagaaagcaggacaagcgaaaaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10887 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacccaattcgagggcttcactaacctctaccaggtatcaaaaacgctgcgtttcgagctcataccacagggcaaaacactcaagcatatacaagagcaaggcttcatagaagaggacaaggcacggaacgaccactacaaagaactaaaacccatcatcgaccgcatatacaaaacctatgcagaccaatgtctacagctagtccaactagactgggagaacctctccgcggctattgacagttatcgcaaagagaaaacagaagaaacccgcaatgctctaatagaagaacaggccacgtatcgcaacgctatccacgactacttcatcgggcgtacagacaacctaaccgacgcgattaacaaaagacacgccgaaatctacaagggcctcttcaaggcagaactcttcaacggaaaagtcctaaagcaactgggtacagtcaccaccacagaacacgaaaacgccctgctccggtcattcgacaaattcacaacctatttctccggattctatgaaaaccgcaaaaacgtattctctgctgaagacatctctacagccatcccccacagaatcgtacaagacaacttccccaagttcaaagaaaactgccacatcttcacgagactcatcaccgcagtaccttcgctacgagaacactttgagaacgtaaagaaagccataggtatcttcgtctccacctccatcgaggaagtgttctcgttcccattttacaaccaactgctgacccaaacccaaatcgacctatacaaccagttacttggaggtataagccgggaagccggaaccgagaaaatcaaaggcctgaacgaagtactaaacctcgccatccagaaaaacgacgaaacagcccacattatcgcatcccttccgcatcgcttcattcccctcttcaaacaaatactctcagaccggaacacccttagcttcatcctagaagagtttaagtccgacgaagaagtcattcaatccttctgcaaatacaaaaccctccttcgcaacgaaaatgtactagaaaccgccgaggccctcttcaacgaactcaactccatcgacctcacccacatcttcatctcccataagaaattagagaccatatcctcagcgctttgcgaccactgggacaccctccgcaacgccctctatgagcgacgaatctccgaactcaccggcaaaatcaccaaatcagctaaagaaaaagtccaacgctcgctaaaacacgaggacatcaacttacaagagataatctccgccgctggtaaagagctctccgaggcattcaaacagaaaacctccgaaatactatcccacgcccatgcagccctggaccaaccgctccccacaaccctcaagaaacaagaggaaaaagagatcctaaaaagccaactagactccctcctaggcctataccacttgctcgattggttcgcagtcgacgaatccaatgaagtcgatccagagttcagcgcgcgcttaacaggaataaaactagaaatggaaccctcccttagtttctacaacaaagcccgaaactacgccacgaagaaaccgtactccgtcgaaaaatttaaactcaactttcaaatgcccactctcgcaagcggctgggacgttaacaaagagaagaacaacggcgccatactattcgtcaaaaacggactctattacttaggtatcatgcccaaacaaaaaggccgctacaaagccctgagcttcgaacccaccgaaaagacatcagaaggctttgacaaaatgtattatgattacttccccgacgcagccaagatgatcccaaaatgctctacgcaactaaaagccgtaaccgcccacttccaaacccacaccaccccgatactactatccaataacttcatagaaccgctcgaaattaccaaagagatctacgacctcaacaacccagaaaaggagcccaagaaattccaaacagcctacgcaaagaaaaccggagatcaaaaaggctaccgcgaagccttgtgcaaatggatagactttacccgtgacttcctttcaaaatacaccaaaacaaccagcatcgatctatcgtctttacgcccctcatcacaatacaaagacctgggcgagtactacgcggagctgaaccccctactataccacatctcattccaacgaatcgcagaaaaagaaatcatggacgccgtcgaaacgggtaaactatacctctttcaaatctacaacaaagactttgccaagggccaccacggaaagccaaacctccacaccctctactggacaggcttatttagcccagagaacctagcaaagacatccataaaacttaacggacaagcagaactattttaccggccaaagtcacgcatgaaaaggatggcacaccgcctaggagaaaagatgttaaacaaaaagctaaaggatcagaaaacgccaatccccgacacattataccaagaactctatgactacgtcaaccaccgcctgtcgcacgacctatcggacgaagcacgcgccctcctgccaaacgtaatcaccaaagaggtatcgcacgagatcatcaaagacagacgattcacctctgacaaattcttcttccatgtccccataaccttaaactaccaagcagcaaactccccgagcaagttcaaccaacgagttaatgcctacctaaaagaacacccagagacaccgataataggcatcgaccgaggcgaacgcaatctcatctacatcaccgtaattgactcaaccgggaagatcctagagcaacgtagcctgaacacaatacagcaatttgattaccaaaagaaactagacaaccgcgaaaaagagagagtcgccgcccgacaggcttggagcgtagtcggcacaatcaaagacttgaagcaaggatacctgagccaagtgatccacgagattgtggacctcatgattcactaccaagcagtagtggtactcgaaaacctgaacttcggcttcaaaagcaaacgcacaggcatcgccgaaaaagccgtatatcaacaattcgaaaagatgctcatagacaagctcaactgcctggtgctaaaggactatccggcggagaaagtaggaggggtcctcaacccctaccaactcaccgaccaatttacctcatttgcgaaaatggggacccaatccggattccttttctacgtccccgcaccgtacacatctaagatcgacccattaacaggattcgtagacccattcgtgtggaaaaccatcaaaaaccatgagagccgaaagcacttccttgaaggattcgacttccttcactatgacgtcaaaacaggggacttcattctacacttcaaaatgaatcgtaatctgtcctttcaacgaggtctacccggattcatgcccgcgtgggacatcgtcttcgagaaaaacgaaacacaattcgacgcaaaaggtacgccatttatcgctggaaagcgcatcgtacccgtcatcgaaaaccaccgattcaccgggcgctaccgtgacctgtaccccgccaacgaactcatcgcactcctggaagaaaagggcatagttttcagagacggctcaaacatcctgcccaagctcctcgaaaacgacgactctcatgcaattgacacaatggtagcacttatacgaagcgttttacaaatgcgcaacagtaacgctgccacaggagaagactatatcaactcccccgtccgcgacctcaacggcgtttgcttcgactcaaggttccagaaccccgaatggcccatggacgccgacgccaacggcgcctatcacatcgcactaaagggccaactcctcctcaatcacctaaaagaatccaaagacctcaagctccagaacggtatatccaaccaagactggctcgcatacatacaagagctgcgaaacaagcgccccgccgccactaaaaaggcagggcaagccaagaaaaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10888 - RNA, 4344 nt, synthetic construct
  misc_feature 1..4344: note = Cpf1 variant mRNA product
  source 1..4344: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcaatataccaggagttcgtcaacaaatacagcctcagcaaaaccctccgcttcgaactcataccccagggaaaaaccctagaaaacatcaaagcgagaggcctcatcctagatgacgagaaacgcgcaaaagactacaagaaagcaaaacaaatcatagataaataccatcagttcttcatagaagaaatcttaagctccgtctgcatatccgaagacctcctacaaaactactctgacgtctacttcaaactgaagaagagtgacgacgacaacctccaaaaagacttcaaatcggcaaaggacaccatcaagaaacaaatctctgaatacataaaagactccgaaaaattcaaaaatctgttcaaccaaaacctgatcgacgccaaaaagggccaagaaagcgacctcatcctgtggctcaaacaaagcaaagataacggaatagaactattcaaggcgaactccgacataaccgacatagacgaagcattagaaattatcaaatcgttcaaggggtggacgacatacttcaaaggcttccacgaaaatcgcaagaacgtctactctagcaatgacatccccaccagcatcatctatagaatagtcgacgacaacctaccaaaattccttgagaacaaagccaaatacgagtccctaaaggacaaagctcccgaagccatcaattacgaacaaataaagaaagacctagccgaggaactcaccttcgacatagactacaaaacctccgaggtcaaccaacgggtcttcagtctggatgaagttttcgaaattgccaacttcaacaactacctcaatcagtcaggcattacaaaattcaacaccataataggcggaaaattcgtaaacggcgaaaacaccaaacgcaaaggaatcaacgagtacatcaacctctattcgcaacagataaatgacaaaacactcaagaaatacaaaatgagtgtgttattcaagcagatcctatcggacaccgaatctaagtcgttcgtcatagacaagctagaggacgacagcgacgttgtgacaacgatgcagtctttttacgaacagatcgcagcgtttaaaaccgtcgaagagaaaagcatcaaagaaaccctcagtctgttattcgatgacctaaaagcacaaaaactcgacctcagcaaaatctacttcaaaaacgacaagtccctaacggacttatcccagcaggtcttcgacgactactccgtcattggcaccgcagtgctagagtacatcacccaacaaatagctcccaaaaacctggacaacccgagtaagaaagagcaagagctaatagccaagaaaacagagaaagccaaatacctaagcctcgaaacaataaaacttgcattagaagagttcaacaaacaccgcgacatagacaaacaatgccgctttgaagagatactcgctaacttcgccgccatcccaatgatctttgacgagatagctcaaaacaaggacaacctcgcgcaaatctcaataaaataccaaaaccaaggaaagaaagatctcctacaagcaagcgccgaagatgacgtcaaagcgatcaaagatctactcgaccagacaaataacttgctgcacaagctcaaaatattccacatcagccaatccgaggacaaggcgaacatcttagacaaagacgagcacttctacctcgtcttcgaagaatgctactttgagctggcaaacatcgtgcccctgtacaataaaatcagaaactacatcacccaaaaaccctactccgacgaaaaattcaagctgaacttcgaaaattcgaccctggccaatggctgggataagaacaaagaacccgacaacaccgccatcttattcatcaaagacgacaaatattacctcggagtcatgaataagaaaaacaacaaaatcttcgacgacaaagcaataaaagaaaacaaaggagaaggttacaagaaaatcgtatacaaactacttcccggagccaacaaaatgctgcccaaagtcttcttcagcgctaaaagcataaaattctacaacccaagcgaggatatcctacggatcaggaaccacagcacccacaccaagaacggcagcccccagaaaggctacgagaagttcgagttcaacatagaagactgtcggaaattcatagacttctacaaacaatcgataagtaaacaccccgaatggaaggacttcggatttcggttctctgatacccagcgctacaactccatagacgagttctatcgagaagtagaaaaccaaggctacaaactcactttcgaaaacatctccgaaagctacatagacagcgttgttaaccagggcaaactgtacctcttccaaatatacaacaaggacttcagcgcctactcgaaaggccggcctaatctacacacactctactggaaggctctcttcgacgaaaggaacctgcaagacgttgtatacaagctcaacggcgaggcagaactcttctatcggaaacaaagtatccccaaaaagataacccacccagccaaagaggccatcgccaacaaaaacaaagataaccccaagaaggagagcgtgtttgagtacgacctaataaaagacaaacgcttcacggaggacaagttcttctttcactgtccaatcacaataaatttcaaatcctccggcgctaacaaatttaacgacgaaataaatctcttactcaaggaaaaggccaacgacgtccacatcctctcgatagacaggggcgaacggcaccttgcatattacacactcgttgacggaaaaggaaacatcataaaacaagacacattcaacatcatcggcaacgaccgaatgaagaccaattaccacgacaaactagccgctatagagaaagatagagacagcgcccgaaaggactggaagaaaatcaacaacataaaagagatgaaagagggatacctctcccaggtggtgcacgaaatagcgaaactcgtcatcgagtacaacgcaattgtagttttcgaggatctcaacttcggtttcaaacgcggccgcttcaaggtagaaaagcaagtgtaccaaaaactcgaaaagatgctgatcgaaaaactcaactacctcgtattcaaagataacgagttcgacaagaccgggggcgtgttaagagcttaccaactcaccgcgccttttgaaacattcaagaaaatgggcaaacagaccggcatcatctactacgtccccgccgggttcacgtccaaaatctgccctgtgaccgggttcgtcaatcaactgtatcccaagtacgaatccgtctcaaaatcgcaggagttcttcagcaagtttgataaaatatgctacaacttagacaaaggctacttcgaattttccttcgactacaaaaacttcggggacaaagccgccaaaggcaagtggaccatagccagcttcggcagccggctcataaatttccgcaattctgacaaaaaccacaactgggacactcgagaggtgtaccccactaaggaactcgaaaagttgcttaaggactactccatcgaatacggacacggggagtgcatcaaggccgccatatgcggcgaatccgacaaaaagttcttcgccaagctaacctcggtcctaaacacaatcctgcaaatgcgcaatagcaagacggggaccgagcttgactacctcatatcacctgtagccgacgtaaacggaaacttcttcgactcacgccaagcccccaaaaacatgccacaagacgcagacgccaacggagcataccacatagggctaaagggccttatgctcctaggacgcatcaaaaacaaccaggaaggaaagaaactcaatctggtcatcaaaaacgaagaatatttcgagttcgtacaaaaccgcaacaacaaacggcccgcagccactaagaaagccggccaagccaagaagaagaaataataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10889 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacccagttcgagggcttcacgaacctgtaccaggtgagcaagacgctccgcttcgagctgatcccccaggggaagaccctaaagcacatccaggagcagggcttcatcgaggaggacaaggcccggaacgaccactacaaggagctcaagccgatcatcgaccgcatctacaagacctacgccgaccagtgcctgcaactggtacagctcgactgggagaacctgtccgcggccatcgacagctatcggaaggagaagaccgaggagacgcgcaacgccctgatcgaggagcaggccacataccggaacgccattcacgactacttcatcgggcgcaccgacaacctcaccgacgcgatcaacaagcggcacgccgagatctacaagggcctgttcaaggccgagctattcaacgggaaggtgctcaagcagctgggcacggtgaccaccaccgagcacgagaacgccctgctccgctcctttgacaagttcacgacctacttcagcggcttctacgagaaccggaaaaacgtcttctccgcggaggacattagcaccgccatcccccaccgcatcgtgcaggacaacttccccaagttcaaggagaattgtcacatattcacccggctgatcacggccgttccctccctgcgcgagcacttcgagaacgtcaagaaggccatcgggatctttgtgagcacctccatcgaggaggtgttcagcttcccgttctacaaccagctgctgacccagacccagatcgacctgtacaaccagctcctgggcgggatatcccgggaggccggcacggagaagatcaaggggctgaacgaggtactcaacctggcgatccagaagaacgacgagaccgctcacatcatcgccagcctgccccaccgcttcatccccctcttcaagcagatcctgtccgaccggaacaccctgagcttcatcctcgaggagttcaagtccgacgaggaggtgatccagtcgttctgcaagtacaagaccctgctgcgcaacgagaacgtgctcgagacggcagaggccctgtttaacgagttaaactccatcgacctcacccacatctttatcagccacaagaaacttgagaccatctccagcgcgctgtgcgaccactgggataccctccggaacgccttgtacgagcgccggatcagcgagctgacgggcaagatcaccaaatccgccaaggagaaagtccagcgcagcctcaagcacgaggacatcaacctgcaggagatcatctccgccgccggcaaggagctgagcgaggcgttcaagcagaagacctctgagatcttgagccacgcccacgccgcactggaccagcccctcccgaccacgctcaagaagcaggaggagaaggagatcctgaagtcccagctggactccttgctcgggctgtaccacctcctcgactggttcgccgtggacgagtccaacgaggtggaccctgagttcagcgcgcgtctgaccggcatcaagctggagatggagccctcgctctcattctacaacaaggcccgcaactacgccaccaagaagccctactccgtcgagaagttcaagctgaacttccagatgccgaccctggcctccgggtgggacgtgaacaaggagaagaacaacggcgcgatcctcttcgtgaagaacggcctgtactacctggggatcatgcccaagcaaaagggccgatataaggccctctccttcgagcccacggagaagaccagcgaggggttcgacaagatgtactacgactacttccccgacgccgccaagatgatcccgaagtgctccacccagctgaaggccgtcaccgcgcacttccagacccacacgacccccatcctgctcagcaacaacttcatcgagcccctggagatcaccaaggagatctacgacctgaacaacccggagaaggagccgaagaagttccagactgcctacgcgaagaagacgggcgaccagaaagggtaccgggaggccctctgcaagtggatcgacttcacccgcgacttcctgtccaagtacaccaagaccacgagcatcgacctgagctccctccggcccagctcccagtacaaggacctgggcgagtactacgccgagctgaaccccctcctgtaccacatcagctttcagcgcatcgcggagaaggaaatcatggacgcagtggagaccggaaagctgtacctcttccagatctacaacaaggacttcgccaaggggcaccacggcaagcccaacttgcacaccctgtactggaccggcctcttctccccggagaacctggccaagacgagcatcaagctgaacgggcaggccgagctgttttaccggcccaagtcccgcatgaagcggatggcgcaccgcctgggggagaagatgctgaacaaaaagctcaaggaccagaagactcccatccccgacaccctgtaccaagagctgtacgactacgtgaaccaccggctcagccacgacctgtccgacgaggcccgcgccctgctcccgaacgtcatcaccaaggaggtgagccacgagatcatcaaggaccggcgctttacgtccgacaagttcttcttccatgtgcccatcaccctgaactaccaggccgcaaacagcccctccaagttcaaccagcgggtcaacgcttacctgaaggagcacccggagacccccatcatcggcatcgaccgcggcgagaggaatctcatctacatcaccgtgatcgacagcacggggaagatcctggagcagcgctccctgaacaccatccagcagttcgactaccagaagaagctcgacaaccgggagaaggagcgcgtcgccgcccggcaggcctggagcgtggtgggcaccatcaaggacctgaagcagggctacctgagtcaggtcatccacgagatcgtggacctcatgatccactatcaagcggtggtcgtgctggagaacctgaacttcggcttcaaaagcaagcgcaccgggatcgccgagaaggccgtgtaccagcagttcgagaagatgctcatcgacaagctgaactgcctggtcctcaaggactaccccgccgagaaggtgggcggcgtgctgaacccctaccagctgacggaccagttcaccagcttcgccaagatggggacccagtccggcttcctcttctacgtcccggcaccctacaccagcaagatcgaccccctgacggggttcgtggaccccttcgtgtggaagaccatcaagaaccacgagtcccgcaagcacttcctggagggcttcgacttcctccactacgacgtcaagaccggcgacttcatcctgcacttcaagatgaaccggaacctgagcttccagcgcgggctcccgggcttcatgcccgcctgggacatcgtgttcgagaagaacgagacccagttcgacgctaaggggaccccattcatcgccggcaaacggatcgtgcccgtcatcgagaaccaccgcttcaccgggcggtaccgcgacctgtacccagccaacgagctgatcgcgctcctggaggaaaaaggcatcgtgttccgggacggctccaacatcctgcccaagctcctggagaacgacgacagccacgccatcgacaccatggtggccctgatccgctccgtcctccagatgcggaacagcaacgccgcgaccggggaggactacatcaactcccccgtgcgcgacctgaacggcgtgtgcttcgacagccggttccagaaccccgagtggccgatggacgccgacgccaacggggcctaccacatcgccctgaagggtcagctcctgctgaaccatctcaaggagtccaaggacctgaagctgcagaacgggatcagcaaccaggactggctcgcgtacatccaggagctgcgcaacaagcgacccgcagccacgaagaaggccggccaggccaagaagaaaaagtgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10890 - RNA, 4344 nt, synthetic construct; identical to SEQ ID NO: 10880
  misc_feature 1..4344: note = Cpf1 variant mRNA product
  source 1..4344: mol_type = other RNA

SEQ ID NO: 10891 - RNA, 4365 nt, synthetic construct
  misc_feature 1..4365: note = Cpf1 variant mRNA product
  source 1..4365: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgacgcaatttgaaggattcaccaacctgtatcaagtctcaaaaacactcaggttcgaactaatcccccaagggaaaactctgaaacatatccaagagcaaggcttcatagaagaagacaaagcacgcaacgatcattacaaagagcttaaaccaattatagacagaatatacaaaacatacgctgaccaatgtttacaattagtccaactagactgggaaaatctatccgccgcaatcgactcttaccgaaaagagaaaactgaagaaacacgcaacgcacttatagaagaacaagcaacatacagaaacgcaatacatgactacttcattgggcgcacagacaaccttactgatgctataaataaacgccatgctgaaatatataaaggactttttaaagcagagcttttcaatggtaaagtcttaaaacagttaggcaccgtaacaaccactgagcatgaaaacgcccttctacgttcgttcgataaatttacaacatatttttcaggcttttatgaaaatcgcaaaaacgtattttcagcagaggacataagtactgcaataccacataggatcgtgcaagacaactttccaaaattcaaagaaaattgccacatattcacaagactaataacggccgtaccttcacttagagaacatttcgaaaacgtcaagaaagctataggaattttcgtctcgacaagcatagaagaagtatttagcttcccattctataaccaactcttaactcaaacacaaatagatttatacaatcaactattaggaggaatctcaagagaggcaggaaccgagaaaatcaaaggacttaatgaagtgttaaatcttgcaattcagaaaaacgatgaaacggcccatataattgcaagtctaccccaccgcttcatccccttatttaaacaaattttatcagatcgaaataccttaagtttcatactagaagaatttaaaagcgatgaagaagtaattcaaagtttctgcaaatataaaacactgctgagaaatgaaaatgtactagaaactgcagaagcattattcaatgaattaaactctatagacctaacccatatatttatatctcacaagaaactcgaaaccatatcttcagcattatgtgaccattgggacactctaagaaatgccttatatgaaagacgcattagtgaactcacgggtaaaataaccaaatccgcaaaagaaaaagtccaacgctctctaaaacacgaagacataaacttgcaagaaataataagcgccgcaggaaaagaactttcagaagcatttaaacagaaaacgtcagaaatcctaagtcatgcacatgcagcattagaccaacctcttcccacaacattaaagaaacaagaagaaaaagaaatattaaaaagtcaattagattcactactcggtctttaccacctcctagattggtttgcagtagacgaatccaacgaagtagatccagagttctctgcacgcttaactggaataaaattagaaatggaaccatccctatctttttataataaagcacgaaactatgcaactaagaaaccctactcagttgaaaaattcaaactcaattttcaaatgccaactctcgcatccgggtgggacgtcaataaagagaaaaataacggcgctattctttttgttaaaaacggtctttattacttaggaattatgcccaaacaaaaaggaagatataaagcactgtcgttcgaaccaactgagaaaacatcagaaggcttcgataaaatgtactatgattactttcctgacgcagcaaaaatgattccaaaatgctcaacacaactcaaagcagtaacagcacacttccaaacacacacaacaccaatactattatctaataattttatcgaaccactagaaatcactaaagaaatatatgacttaaataacccagaaaaagaaccaaagaaattccaaactgcgtatgctaagaaaacaggagaccaaaaaggatatagggaagcattatgtaaatggatagactttacacgagatttccttagtaaatacaccaaaacaacaagtatagatctatcaagcctacgaccatcatcacaatataaagacctaggagaatattacgcggaactaaaccctctactataccacatctcctttcaacgtatcgctgaaaaagaaatcatggatgctgttgaaactggtaaactatatctatttcaaatatataacaaagacttcgctaaaggtcaccacggaaaaccaaatctacatacactatactggactggtttgttcagtccagaaaaccttgccaaaacaagtataaaattaaatggtcaagcagaactattctaccgacccaaatcacgaatgaaacgtatggcccatcgattaggtgagaaaatgttaaacaagaaattaaaagaccagaaaacaccaataccagataccctataccaagaattatacgattacgtaaaccatagactaagccacgatttatccgacgaagcaagagcactactaccaaacgtaatcaccaaagaagtctcgcacgaaataataaaggatagaagattcacatctgacaaatttttctttcacgtcccaataactcttaattaccaagccgcaaactccccttccaaattcaaccaacgagtaaatgcatatttgaaagaacatccggaaacacctattattggaatcgatcgaggtgaaaggaacctaatttacataacagttatagacagcacaggaaagatcctagagcaaagaagcctaaacacaatacaacaattcgattaccaaaagaaacttgacaatagagaaaaagaaagagtagctgcaagacaggcttggtccgtagtgggcactataaaagatctcaaacaaggatacttatcacaagtaatccatgaaatagtagaccttatgatacattaccaagctgtagtagtactagaaaatctaaactttggttttaaatcgaaaagaaccggtatagcagaaaaagctgtataccaacaattcgagaaaatgctaatagataaacttaattgccttgtcttaaaagattatccagcagaaaaagttggcggagtcttaaatccatatcagctcacggaccaatttacctcttttgcaaaaatgggcacacaatccggatttttattctatgtaccagcaccttacacaagtaagattgacccactaactggatttgtagacccttttgtatggaaaactatcaaaaaccacgagtcacgtaaacattttctagaaggttttgactttcttcactacgatgtcaaaacgggagattttatattacactttaaaatgaaccgtaatttaagtttccaacgcggattaccaggatttatgccagcctgggacatagtgttcgagaaaaacgaaacacaatttgacgcaaaaggaacaccctttatagctggaaaaagaattgtaccagttattgaaaatcatagatttacgggacgatatagagatctttacccagctaacgaactgattgcactccttgaagaaaagggaatagtctttcgagatggcagtaacatattacctaaactactagaaaatgatgattcccacgctatagacacaatggtagcccttataaggagtgtactacaaatgcgaaactcaaatgccgccactggcgaagactacatcaatagcccagtaagggacctaaacggcgtatgttttgactctagatttcaaaaccctgaatggccaatggacgctgatgctaatggtgcttaccatatagctctaaaaggacaactactgttaaatcacctgaaggaatccaaagacctaaaactacaaaacggaataagtaaccaagactggttagcatatatacaagaactacgaaacaaaagaccagctgccaccaagaaagctggacaagctaaaaagaagaaatgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10892 - RNA, 4344 nt, synthetic construct
  misc_feature 1..4344: note = Cpf1 variant mRNA product
  source 1..4344: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcaatttaccaagaatttgtaaacaaatatagcctctcaaaaacgctacgatttgaactaattccacaaggcaaaacacttgagaatatcaaagccagaggcttgatacttgatgacgagaaacgcgccaaagactacaaaaaagcaaaacaaataattgataaatatcaccaattttttattgaagaaatactatctagtgtctgtatatctgaagaccttctccaaaattacagcgacgtatattttaaattaaaaaaatccgacgacgataatctacaaaaagacttcaaatcagctaaagacaccatcaaaaaacaaataagcgaatatataaaagatagcgaaaaattcaaaaacctattcaaccaaaacctaatcgatgctaaaaaaggccaagaatcagatcttatactctggctcaaacagtcaaaagacaacggaatagaattattcaaagcaaacagtgatataacagacatagacgaagcattagaaataataaaatccttcaagggatggactacatacttcaaaggtttccacgaaaacagaaaaaatgtatactcgagcaatgacataccaaccagcataatttacaggatagtagacgacaatctaccaaaattcttagaaaacaaagcaaaatatgaaagtttaaaagataaagccccagaagcaataaactatgagcaaataaaaaaagatctcgcagaagaactaacattcgatatagactacaagacatcagaagtcaatcaacgagtattttctctagacgaagtattcgagattgcaaacttcaataactacttaaatcaaagtggtattacaaaattcaataccatcataggtggaaaattcgtaaacggagaaaacacaaaacgcaaaggcataaacgagtacataaatctctatagtcaacaaattaatgacaaaactttaaaaaaatacaaaatgtctgtccttttcaaacaaatccttagcgatacagagtcaaaatcatttgtcatagacaaactggaggacgatagtgacgtagtaactacaatgcaaagcttttatgaacagattgctgctttcaaaacagtagaagagaaatccataaaagaaaccctctctttactcttcgacgatttaaaagcccagaaattagatcttagcaaaatttattttaagaatgacaaaagtttgacagacttatcccagcaggtttttgatgactactccgtaatcggtacagccgtactagaatatataacccagcaaatcgcccccaagaacctagataaccctagcaagaaagaacaagaattaatagccaaaaagacagaaaaggccaaataccttagtctagaaacaataaaactagccctagaagaatttaacaaacatcgagatatagacaaacaatgtcgctttgaagaaatcctcgctaactttgcagcaataccaatgatcttcgacgaaatagcacaaaataaagacaacctcgcccagatatcaatcaaataccaaaaccaaggaaagaaagatctactacaagcctcagcagaggacgacgtaaaagctatcaaagatctactcgaccaaactaataaccttctacataaattaaaaatcttccacatttctcaaagcgaagacaaggcaaatatactagacaaagacgaacatttttacctagtattcgaggaatgctacttcgaactagctaacatcgtacctttatataacaaaatcagaaactacataactcaaaaaccatattcagatgaaaaattcaaacttaacttcgaaaactctaccctcgcaaatggttgggacaagaacaaagaaccagacaacaccgcaatcttatttatcaaagacgataaatattacctaggcgtcatgaacaaaaaaaataacaaaatattcgatgataaagcaataaaagaaaacaaaggcgaaggatacaagaaaatagtatacaaactcctacccggtgcaaataaaatgctacctaaagtatttttcagtgccaaaagcattaaattctacaatccaagcgaagacatccttcgaataagaaaccattcaacgcacacaaaaaatggatctccacaaaaaggttacgaaaaattcgaattcaacatagaagactgccgaaaattcatagacttctataaacaatccattagtaaacatccagaatggaaagactttggatttcgtttttcagatacccaacgatacaatagtatagacgaattctacagagaagtagaaaatcaaggatataaattaacattcgaaaatatttccgaatcttatatagacagtgtagttaatcaaggcaaattgtatttattccagatatataacaaagacttcagtgcctactcaaaaggtagaccaaatctccacaccctttattggaaggcactatttgacgaaaggaacctccaagatgtagtttacaaactaaatggcgaagcagaactattttatagaaaacaaagcatccccaaaaaaataactcacccagcaaaagaagcaatagcaaataaaaataaagacaaccctaaaaaggaatcagtctttgaatacgacctaataaaagataaacgatttacagaagacaaattcttcttccactgcccaatcaccatcaatttcaaaagctccggagcaaataaattcaacgacgaaataaacctcttgctaaaagagaaagccaatgacgtacacatactcagtatagatagaggagaaagacacttagcttactatacacttgtagatgggaaagggaacataataaaacaagatacatttaatataataggaaacgacagaatgaaaacaaattaccatgacaaactagctgcaatcgaaaaagacagagatagtgcaagaaaagactggaaaaaaatcaacaacataaaagaaatgaaagaaggatacttaagccaagtcgtacatgaaatagctaagttagtgatcgagtacaacgcgatagtagtcttcgaagatctcaatttcggcttcaaaagaggaagattcaaggtagaaaaacaagtttatcagaaattagaaaagatgttaatagaaaaactgaactatttagtgttcaaagataacgaatttgacaaaaccggcggggtactaagagcataccaattaacagctccattcgagaccttcaaaaaaatgggtaaacaaacaggtataatttattacgttcccgccggatttacctcaaaaatatgtcctgttactggattcgtaaaccaactataccctaagtatgaaagtgtgagtaaaagccaagaattcttctcaaaatttgacaaaatatgttacaacctggacaaaggatacttcgaattttcattcgattacaaaaatttcggtgacaaagctgccaaaggaaaatggacgatagcatccttcggttcaagactaatcaacttccgtaattccgacaagaaccataactgggacacaagagaagtctacccaacaaaagagctagagaaactgctaaaagattatagtatagaatacggccatggcgaatgcataaaagcggcaatttgcggagaatccgacaaaaaatttttcgcaaaactcacctcagtactcaacacaatcctacaaatgagaaactcaaaaacaggtacagaactagattacttgatttctcccgttgcagatgtaaacggaaatttctttgattcgagacaagcacctaaaaacatgcctcaagatgcagacgcaaacggtgcttaccacataggcttaaaaggattaatgttgttaggaagaataaaaaataaccaagaaggcaaaaaattaaatctggtaatcaaaaatgaagaatacttcgaattcgtacaaaatagaaacaataagagacccgctgccacaaagaaagctggacaagccaaaaaaaaaaaatagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 10893 - protein, 1159 aa, synthetic construct
  REGION 1..1159: note = Cas13a variant__Leptotrichia buccalis__WP_015770004.1__Cas13a
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10894 - protein, 1159 aa, synthetic construct
  REGION 1..1159: note = Cas13a variant__Leptotrichia buccalis__WP_015770004.1__Cas13a(R472A,H477A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIAHGIVAFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10895 - protein, 1159 aa, synthetic construct
  REGION 1..1159: note = Cas13a variant__Leptotrichia buccalis__WP_015770004.1__Cas13a(R1048A,H1053A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIANYIAAFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10896 - protein, 1159 aa, synthetic construct
  REGION 1..1159: note = Cas13a variant__Leptotrichia buccalis__WP_015770004.1__Cas13a(R472A,H477A,R1048A,H1053A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIAHGIVAFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIANYIAAFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10897 - protein, 1159 aa, synthetic construct
  REGION 1..1159: note = Cas13a variant__Leptotrichia buccalis__WP_015770004.1__Cas13a(R1079A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDAKLKNAVMKSVVDILKEYGFVATFKIGADKKIGIQTLESEKIVHLKNLKKKKLMTDRNSEELCKLVKIMFEYKMEEKKSEN

SEQ ID NO: 10898 - protein, 1159 aa, synthetic construct
  REGION 1..1159: note = Cas13a variant__Leptotrichia buccalis__WP_015770004.1__Cas13a(E299A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIAMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10899 - protein, 1159 aa, synthetic construct
  REGION 1..1159: note = Cas13a variant__Leptotrichia buccalis__WP_015770004.1__Cas13a(K310A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYARLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10900 - protein, 1159 aa, synthetic construct
  REGION 1..1159: note = Cas13a variant__Leptotrichia buccalis__WP_015770004.1__Cas13a(N314A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSAISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10901 - protein, 1159 aa, synthetic construct
  REGION 1..1159: note = Cas13a variant__Leptotrichia buccalis__WP_015770004.1__Cas13a(R1072A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLAKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10902 - protein, 1159 aa, synthetic construct
  REGION 1..1159: note = Cas13a variant__Leptotrichia buccalis__WP_015770004.1__Cas13a(D1078A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYARKLKNAVMKSVVDILKEYGFVATFKIGADKKIGIQTLESEKIVHLKNLKKKKLMTDRNSEELCKLVKIMFEYKMEEKKSEN

SEQ ID NO: 10903 - protein, 1159 aa, synthetic construct
  REGION 1..1159: note = Cas13a variant__Leptotrichia buccalis__WP_015770004.1__Cas13a(R1079A,K1080A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDAALKNAVMKSVVDILKEYGFVATFKIGADKKIGIQTLESEKIVHLKNLKKKKLMTDRNSEELCKLVKIMFEYKMEEKKSEN

SEQ ID NO: 10904 - protein, 1159 aa, synthetic construct
  REGION 1..1159: note = Cas13a variant__Leptotrichia buccalis__WP_015770004.1__Cas13a(K1080A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRALKNAVMKSVVDILKEYGFVATFKIGADKKIGIQTLESEKIVHLKNLKKKKLMTDRNSEELCKLVKIMFEYKMEEKKSEN

SEQ ID NO: 10905 - protein, 1159 aa, synthetic construct
  REGION 1..1159: note = Cas13a variant__Leptotrichia buccalis__WP_015770004.1__Cas13a(K1082A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLANAVMKSVVDILKEYGFVATFKIGADKKIGIQTLESEKIVHLKNLKKKKLMTDRNSEELCKLVKIMFEYKMEEKKSEN

SEQ ID NO: 10906 - protein, 1159 aa, synthetic construct
  REGION 1..1159: note = Cas13a variant__Leptotrichia buccalis__WP_015770004.1__Cas13a(K1087A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMASVVDILKEYGFVATFKIGADKKIGIQTLESEKIVHLKNLKKKKLMTDRNSEELCKLVKIMFEYKMEEKKSEN

SEQ ID NO: 10907 - protein, 1389 aa, synthetic construct
  REGION 1..1389: note = Cas13a variant__Leptotrichia shahii__WP_018451595.1__Cas13a
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 10908 - protein, 1389 aa, synthetic construct; identical to SEQ ID NO: 10907
  REGION 1..1389: note = Cas13a variant__Leptotrichia shahii__WP_018451595.1__Cas13a

SEQ ID NO: 10909 - protein, 1434 aa, synthetic construct
  REGION 1..1434: note = Cas13a variant__Leptotrichia shahii__WP_018451595.1__Cas13a(long)
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYA

SEQ ID NO: 10910 - protein, 1385 aa, synthetic construct
  REGION 1..1385: note = Cas13a variant__Leptotrichia sp. oral__WP_021744063.1__Cas13a
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 10911 - protein, 1152 aa, synthetic construct
  REGION 1..1152: note = Cas13a variant__Leptotrichia wadei__WP_021746774.1__Cas13a
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10912 - protein, 1152 aa, synthetic construct
  REGION 1..1152: note = Cas13a variant__Leptotrichia wadei__WP_021746774.1__Cas13a(G403D)
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10913 - protein, 1302 aa, synthetic construct
  REGION 1..1302: note = Cas13a variant__Leptotrichia wadei__WP_021746774.1__6xHis-Tag/Twin-Strep/SUMO_Cas13a(G40 3D)
MGSSHHHHHHSSGLVPRGSHMASWSHPQFEKGGGSGGGSGGSAWSHPQFEKMSDSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGGSMKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10914 - protein, 1152 aa, synthetic construct
  REGION 1..1152: note = Cas13a variant__Leptotrichia wadei__WP_021746774.1__Cas13a(R474A,R1046A)
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIAHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIANYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10915 - protein, 1690 aa, synthetic construct
  REGION 1..1690: note = Cas13a variant__Leptotrichia wadei__WP_021746774.1__XY_Cas13a(R474A,R1046A)_EGFP_ZF-CCR5 T_KRAB -A _NLS
MGGEGLRASPRRRPLLPLQPRGCPRGDGCLRGGRGRAGFGFWRVTGGSRASANHVHAFFFFLQLLGNVLVIVLSHHFGKEFGTAGPGATMKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIAHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIANYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYSRGAGAGAGAGAGSRFQCRICMRNFSDRSNLSRHIRTHTGEKPFACDICGRKFAISSNLNSHTKIHTGSQKPFQCRICMRNFSRSDNLARHIRTHTGEKPFACDICGRKFATSGNLTRHTKIHLRGSQLSIVDAPEQREGASQVSVSVTFEDVAVLFTRDEWKKLDLSQRSLYREVMLENYSNLASMAGSPKKKRKV

SEQ ID NO: 10916 - protein, 1182 aa, synthetic construct
  REGION 1..1182: note = Cas13a variant__Leptotrichia wadei__ERK53440.1__Cas13a
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 10917 - protein, 1385 aa, synthetic construct
  REGION 1..1385: note = Cas13a variant__Clostridium aminophilum__WP_031473346.1__Cas13a
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 10918 - protein, 1344 aa, synthetic construct
  REGION 1..1344: note = Cas13a variant__Eubacterium rectale strain__CVRQ01000008.1__Cas13a
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 10919 - protein, 1285 aa, synthetic construct
  REGION 1..1285: note = Cas13a variant__Herbinix hemicellulosilytica__CRZ35554.1__Cas13a
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 10920 - protein, 1437 aa, synthetic construct
  REGION 1..1437: note = Cas13a variant__Lachnospiraceae bacterium__WP_022785443.1__Cas13a
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 10921 - protein, 1051 aa, synthetic construct
  REGION 1..1051: note = Cas13a variant__Listeria newyorkensis__WP_036091002.1__Cas13a
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 10922 - protein, 1120 aa, synthetic construct
  REGION 1..1120: note = Cas13a variant__Listeria seeligeri__WP_012985477.1__Cas13a
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 10923 - protein, 1154 aa, synthetic construct
  REGION 1..1154: note = Cas13a variant__Paludibacter propionicigenes__WP_013443710.1__Cas13a
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10924 - protein, 1285 aa, synthetic construct
  REGION 1..1285: note = Cas13a variant__Rhodobacter capsulatus__ETD76934.1__Cas13a
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 10925 - protein, 525 aa, synthetic construct
  REGION 1..525: note = Cas13a variant__Corynebacterium ulcerans__WP_038617242.1__Cas13
MPKYCLTARFPLGVYLGHTGDANRDAYPDPARLHAALMNAAAQGVHAEEDPNEHQLRPSQQSLQALQWLEAHPPTGLAMPEQQWLSPDTSRMMYRNVGSVKIDKTGVTRATENRAVSDGVSVNGAYGYIWDEMPVDIAEAITALLPDVACLGEASSLVVLEQQEIEATLTLDPQATAFSTERVQVRIALPGRTQHLREVFHARYGKKPPSKKADKFLKDDPIHDPPIPKDHLGTARYLRVNAADKECVTPWTKVILLEVHGKQLGAKEQVRAAVALHRALIARIRTDVSPVITGRYAAGAQRPANNLAIQYIPHRHLEALGLKTSAFALLVPQDADSTVYEQLNQALTGPFPLRSGGKLLCQLKYNGHVFRGDAFWPAPQPGTIRMWEPLNVFIPESRPHNKQQGVLWRLADAGLLSVAFVWRDNFPTKETGPARYVELRDAAYNADVRIFHDHPVSRNTRRFVHRTNRSLTIQPWRGLVHLGSLQQDRAIIALGQSRHLGGGLLIPVDIPRSEFETMTSEMTHA

SEQ ID NO: 10926 - protein, 1224 aa, synthetic construct
  REGION 1..1224: note = Cas13b variant__Bergeyella zoohelcum__WP_002664492.1__Cas13b
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 10927 - protein, 1224 aa, synthetic construct
  REGION 1..1224: note = Cas13b variant__Bergeyella zoohelcum__WP_002664492.1__Cas13b(R116A,H121A,R1177A,H1182A )
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLANFYTAKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIANKFAANQLPKKEFWDYCQEKYGKIEKEKTYAEYFAEVFKKEKEALIK

SEQ ID NO: 10928 - protein, 1127 aa, synthetic construct
  REGION 1..1127: note = Cas13b variant__Prevotella buccae__WP_004343973.1__Cas13b
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 10929 - protein, 1090 aa, synthetic construct
  REGION 1..1090: note = Cas13b variant__Prevotella sp.__WP_044065294__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 10930 - protein, 1383 aa, synthetic construct
  REGION 1..1383: note = Cas13b variant__Artificial____PspCas13b-GS-HsADAR2DD(E488Q,del984- 1090)
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDGSLQLPPLERLTLGSQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLT

SEQ ID NO: 10931 - protein, 1383 aa, synthetic construct
  REGION 1..1383: note = Cas13b variant__Artificial____PspCas13b-GS-HsADAR2DD(E488Q,T375G,d el984- 1090)
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDGSLQLPPLERLTLGSQLHLPQVLADAVSRLVLGKFGDLTDNFSSPHARRKVLAGVVMTTGTDVKDAKVISVSTGGKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLT

SEQ ID NO: 10932 - protein, 953 aa, synthetic construct
  REGION 1..953: note = Cas13b variant__Alistipes sp.__WP_047447901.1__Cas13b
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 10933 - protein, 1115 aa, synthetic construct
  REGION 1..1115: note = Cas13b variant__Bacteroides pyogenes__ERI81700.1__Cas13b
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 10934 - protein, 1115 aa, synthetic construct
  REGION 1..1115: note = Cas13b variant__Bacteroides pyogenes__WP_034542281.1__Cas13b
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 10935 - protein, 1224 aa, synthetic construct; identical to SEQ ID NO: 10926
  REGION 1..1224: note = Cas13b variant__Bergeyella zoohelcum__WP_002664492.1__Cas13b

SEQ ID NO: 10936 - protein, 1199 aa, synthetic construct
  REGION 1..1199: note = Cas13b variant__Capnocytophaga canimorsus__WP_013997271.1__Cas13b
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 10937 - protein, 1218 aa, synthetic construct
  REGION 1..1218: note = Cas13b variant__Capnocytophaga cynodegmi__WP_041989581.1__Cas13b
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 10938 - protein, 1145 aa, synthetic construct
  REGION 1..1145: note = Cas13b variant__Chryseobacterium sp.__WP_047431796.1__Cas13b
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 10939 - protein, 1150 aa, synthetic construct
  REGION 1..1150: note = Cas13b variant__Flavobacterium branchiophilum__WP_014084666.1__Cas13b
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 10940 - protein, 1213 aa, synthetic construct
  REGION 1..1213: note = Cas13b variant__Flavobacterium columnare__WP_060381855.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 10941 - protein, 1179 aa, synthetic construct
  REGION 1..1179: note = Cas13b variant__Flavobacterium columnare__WP_014165541.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 10942 - protein, 1213 aa, synthetic construct
  REGION 1..1213: note = Cas13b variant__Flavobacterium columnare__WP_063744070.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 10943 - protein, 1214 aa, synthetic construct
  REGION 1..1214: note = Cas13b variant__Flavobacterium columnare__WP_065213424.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 10944 - protein, 1155 aa, synthetic construct
  REGION 1..1155: note = Cas13b variant__Flavobacterium sp.__WP_045968377.1__Cas13b
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 10945 - protein, 1159 aa, synthetic construct
  REGION 1..1159: note = Cas13b variant__Myroides odoratimimus__EHO06562.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 10946 - protein, 1157 aa, synthetic construct
  REGION 1..1157: note = Cas13b variant__Myroides odoratimimus__WP_006261414.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 10947 - protein, 1157 aa, synthetic construct
  REGION 1..1157: note = Cas13b variant__Myroides odoratimimus__EKB06014.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 10948 - protein, 1159 aa, synthetic construct
  REGION 1..1159: note = Cas13b variant__Myroides odoratimimus__WP_058700060.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 10949 - protein, 1154 aa, synthetic construct
  REGION 1..1154: note = Cas13b variant__Paludibacter propionicigenes__WP_013446107.1__Cas13b
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 10950 - protein, 1131 aa, synthetic construct
  REGION 1..1131: note = Cas13b variant__Phaeodactylibacter xiamenensis__WP_044218239.1__Cas13b
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 10951 - protein, 1135 aa, synthetic construct
  REGION 1..1135: note = Cas13b variant__Porohyromonas gingivalis__WP_012458151.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10952 - protein, 1135 aa, synthetic construct
  REGION 1..1135: note = Cas13b variant__Porohyromonas gingivalis__ERJ81987.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 10953 - protein, 1135 aa, synthetic construct
  REGION 1..1135: note = Cas13b variant__Porohyromonas gingivalis__ERJ65637.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10954 - protein, 1135 aa, synthetic construct
  REGION 1..1135: note = Cas13b variant__Porohyromonas gingivalis__WP_021665475.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 10955 - protein, 1135 aa, synthetic construct
  REGION 1..1135: note = Cas13b variant__Porohyromonas gingivalis__WP_061156637.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10956 - protein, 1135 aa, synthetic construct
  REGION 1..1135: note = Cas13b variant__Porohyromonas gingivalis__WP_023846767.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10957 - protein, 1135 aa, synthetic construct
  REGION 1..1135: note = Cas13b variant__Porohyromonas gingivalis__ERJ87335.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 10958 - protein, 1135 aa, synthetic construct
  REGION 1..1135: note = Cas13b variant__Porohyromonas gingivalis__WP_005873511.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10959 - protein, 1135 aa, synthetic construct
  REGION 1..1135: note = Cas13b variant__Porohyromonas gulae__WP_039445055.1__Cas13b
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 10960 - protein, 1175 aa, synthetic construct
  REGION 1..1175: note = Cas13b variant__Porphyromonas gingivalis__WP_052912312.1__Cas13b
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 10961 - protein, 1119 aa, synthetic construct
  REGION 1..1119: note = Cas13b variant__Porphyromonas gingivalis__WP_053444417.1__Cas13b
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 10962 - protein, 1119 aa, synthetic construct
  REGION 1..1119: note = Cas13b variant__Porphyromonas gingivalis__WP_012458414.1__Cas13b
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 10963 - protein, 1119 aa, synthetic construct
  REGION 1..1119: note = Cas13b variant__Porphyromonas gingivalis__WP_039417390.1__Cas13b
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 10964 - protein, 1175 aa, synthetic construct
  REGION 1..1175: note = Cas13b variant__Porphyromonas gingivalis__EOA10535.1__Cas13b
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 10965 - protein, 1119 aa, synthetic construct
  REGION 1..1119: note = Cas13b variant__Porphyromonas gingivalis__WP_061156470.1__Cas13b
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 10966 - protein, 1119 aa, synthetic construct
  REGION 1..1119: note = Cas13b variant__Porphyromonas gingivalis__WP_013816155.1__Cas13b
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 10967 - protein, 1175 aa, synthetic construct
  REGION 1..1175: note = Cas13b variant__Porphyromonas gingivalis__WP_005874195.1__Cas13b
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 10968 - protein, 1119 aa, synthetic construct
  REGION 1..1119: note = Cas13b variant__Porphyromonas gulae__WP_039437199.1__Cas13b
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 10969 - protein, 1119 aa, synthetic construct
  REGION 1..1119: note = Cas13b variant__Porphyromonas gulae__WP_039419792.1__Cas13b
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10970 - protein, 1175 aa, synthetic construct
  REGION 1..1175: note = Cas13b variant__Porphyromonas gulae__WP_039431778.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 10971 - protein, 1175 aa, synthetic construct
  REGION 1..1175: note = Cas13b variant__Porphyromonas gulae__WP_046201018.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 10972 - protein, 1174 aa, synthetic construct
  REGION 1..1174: note = Cas13b variant__Porphyromonas gulae__WP_039442171.1__Cas13b
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10973 - protein, 1119 aa, synthetic construct
  REGION 1..1119: note = Cas13b variant__Porphyromonas gulae__WP_039426176.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 10974 - protein, 1175 aa, synthetic construct
  REGION 1..1175: note = Cas13b variant__Porphyromonas gulae__WP_039418912.1__Cas13b
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10975 - protein, 1175 aa, synthetic construct
  REGION 1..1175: note = Cas13b variant__Porphyromonas gulae__WP_039434803.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10976 - protein, 1175 aa, synthetic construct
  REGION 1..1175: note = Cas13b variant__Porphyromonas sp.__WP_039428968.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10977 - protein, 1124 aa, synthetic construct
  REGION 1..1124: note = Cas13b variant__Prevotella aurantiaca__WP_025000926.1__Cas13b
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 10978 - protein, 1127 aa, synthetic construct; identical to SEQ ID NO: 10928
  REGION 1..1127: note = Cas13b variant__Prevotella buccae__EFU31981.1__Cas13b

SEQ ID NO: 10979 - protein, 1127 aa, synthetic construct
  REGION 1..1127: note = Cas13b variant__Prevotella buccae__WP_004343581.1__Cas13b
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 10980 - protein, 1133 aa, synthetic construct
  REGION 1..1133: note = Cas13b variant__Prevotella falsenii__WP_036884929.1__Cas13b
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 10981 - protein, 1133 aa, synthetic construct
  REGION 1..1133: note = Cas13b variant__Prevotella intermedia__BAU18623.1__Cas13b
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 10982 - protein, 1134 aa, synthetic construct
  REGION 1..1134: note = Cas13b variant__Prevotella intermedia__AFJ07523.1__Cas13b
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 10983 - protein, 1132 aa, synthetic construct
  REGION 1..1132: note = Cas13b variant__Prevotella intermedia__WP_014708441.1__Cas13b
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 10984 - protein, 1126 aa, synthetic construct
  REGION 1..1126: note = Cas13b variant__Prevotella intermedia__WP_036860899.1__Cas13b
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 10985 - protein, 1120 aa, synthetic construct
  REGION 1..1120: note = Cas13b variant__Prevotella intermedia__WP_061868553.1__Cas13b
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 10986 - protein, 1125 aa, synthetic construct
  REGION 1..1125: note = Cas13b variant__Prevotella intermedia__KJJ86756.1__Cas13b
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 10987 - protein, 1125 aa, synthetic construct
  REGION 1..1125: note = Cas13b variant__Prevotella pallens__EGQ18444.1__Cas13b
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 10988 - protein, 1150 aa, synthetic construct
  REGION 1..1150: note = Cas13b variant__Prevotella saccharolytica__EKY00089.1__Cas13b
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 10989 - protein, 1322 aa, synthetic construct
  REGION 1..1322: note = Cas13b variant__Prevotella sp.__WP_036929175.1__Cas13b
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 10990 - protein, 1127 aa, synthetic construct
  REGION 1..1127: note = Cas13b variant__Prevotella sp.__WP_007412163.1__Cas13b
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 10991 - protein, 1090 aa, synthetic construct
  REGION 1..1090: note = Cas13b variant__Prevotella sp.__WP_044072147.1__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 10992 - protein, 1090 aa, synthetic construct
  REGION 1..1090: note = Cas13b variant__Prevotella sp.__WP_042518169.1__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 10993 - protein, 1090 aa, synthetic construct
  REGION 1..1090: note = Cas13b variant__Prevotella sp.__WP_044074780.1__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 10994 - protein, 1145 aa, synthetic construct
  REGION 1..1145: note = Cas13b variant__Psychroflexus torquis__WP_015024765.1__Cas13b
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 10995 - protein, 948 aa, synthetic construct
  REGION 1..948: note = Cas13b variant__Riemerella anatipestifer__WP_049354263.1__Cas13b
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 10996 - protein, 1095 aa, synthetic construct
  REGION 1..1095: note = Cas13b variant__Riemerella anatipestifer__WP_004919755.1__Cas13b
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 10997 - protein, 1095 aa, synthetic construct
  REGION 1..1095: note = Cas13b variant__Riemerella anatipestifer__WP_064970887.1__Cas13b
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 10998 - protein, 950 aa, synthetic construct
  REGION 1..950: note = Cas13b variant__Riemerella anatipestifer__WP_061710138.1__Cas13b
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 10999 - protein, 949 aa, synthetic construct
  REGION 1..949: note = ARMAN Cas9 variant__Candidatus Micrarchaeum acidiphilum__OJI07263.1__Cas9
MRDSITAPRYSSALAARIKEFNSAFKLGIDLGTKTGGVALVKDNKVLLAKTFLDYHKQTLEERRIHRRNRRSRLARRKRIARLRSWILRQKIYGKQLPDPYKIKKMQLPNGVRKGENWIDLVVSGRDLSPEAFVRAITLIFQKRGQRYEEVAKEIEEMSYKEFSTHIKALTSVTEEEFTALAAEIERRQDVVDTDKEAERYTQLSELLSKVSESKSESKDRAQRKEDLGKVVNAFCSAHRIEDKDKWCKELMKLLDRPVRHARFLNKVLIRCNICDRATPKKSRPDVRELLYFDTVRNFLKAGRVEQNPDVISYYKKIYMDAEVIRVKILNKEKLTDEDKKQKRKLASELNRYKNKEYVTDAQKKMQEQLKTLLFMKLTGRSRYCMAHLKERAAGKDVEEGLHGVVQKRHDRNIAQRNHDLRVINLIESLLFDQNKSLSDAIRKNGLMYVTIEAPEPKTKHAKKGAAVVRDPRKLKEKLFDDQNGVCIYTGLQLDKLEISKYEKDHIFPDSRDGPSIRDNLVLTTKEINSDKGDRTPWEWMHDNPEKWKAFERRVAEFYKKGRINERKRELLLNKGTEYPGDNPTELARGGARVNNFITEFNDRLKTHGVQELQTIFERNKPIVQVVRGEETQRLRRQWNALNQNFIPLKDRAMSFNHAEDAAIAASMPPKFWREQIYRTAWHFGPSGNERPDFALAELAPQWNDFFMTKGGPIIAVLGKTKYSWKHSIIDDTIYKPFSKSAYYVGIYKKPNAITSNAIKVLRPKLLNGEHTMSKNAKYYHQKIGNERFLMKSQKGGSIITVKPHDGPEKVLQISPTYECAVLTKHDGKIIVKFKPIKPLRDMYARGVIKAMDKELETSLSSMSKHAKYKELHTHDIIYLPATKKHVDGYFIITKLSAKHGIKALPESMVKVKYTQIGSENNSEVKLTKPKPEITLDSEDITNIYNFTR

SEQ ID NO: 11000 - protein, 967 aa, synthetic construct
  REGION 1..967: note = ARMAN Cas9 variant__Candidatus Parvarchaeum acidiphilum__APG80630.1__Cas9
MLGSSRYLRYNLTSFEGKEPFLIMGYYKEYNKELSSKAQKEFNDQISEFNSYYKLGIDLGDKTGIAIVKGNKIILAKTLIDLHSQKLDKRREARRNRRTRLSRKKRLARLRSWVMRQKVGNQRLPDPYKIMHDNKYWSIYNKSNSANKKNWIDLLIHSNSLSADDFVRGLTIIFRKRGYLAFKYLSRLSDKEFEKYIDNLKPPISKYEYDEDLEELSSRVENGEIEEKKFEGLKNKLDKIDKESKDFQVKQREEVKKELEDLVDLFAKSVDNKIDKARWKRELNNLLDKKVRKIRFDNRFILKCKIKGCNKNTPKKEKVRDFELKMVLNNARSDYQISDEDLNSFRNEVINIFQKKENLKKGELKGVTIEDLRKQLNKTFNKAKIKKGIREQIRSIVFEKISGRSKFCKEHLKEFSEKPAPSDRINYGVNSAREQHDFRVLNFIDKKIFKDKLIDPSKLRYITIESPEPETEKLEKGQISEKSFETLKEKLAKETGGIDIYTGEKLKKDFEIEHIFPRARMGPSIRENEVASNLETNKEKADRTPWEWFGQDEKRWSEFEKRVNSLYSKKKISERKREILLNKSNEYPGLNPTELSRIPSTLSDFVESIRKMFVKYGYEEPQTLVQKGKPIIQVVRGRDTQALRWRWHALDSNIIPEKDRKSSFNHAEDAVIAACMPPYYLRQKIFREEAKIKRKVSNKEKEVTRPDMPTKKIAPNWSEFMKTRNEPVIEVIGKVKPSWKNSIMDQTFYKYLLKPFKDNLIKIPNVKNTYKWIGVNGQTDSLSLPSKVLSISNKKVDSSTVLLVHDKKGGKRNWVPKSIGGLLVYITPKDGPKRIVQVKPATQGLLIYRNEDGRVDAVREFINPVIEMYNNGKLAFVEKENEEELLKYFNLLEKGQKFERIRRYDMITYNSKFYYVTKINKNHRVTIQEESKIKAESDKVKSSSGKEYTRKETEELSLQKLAELISI

SEQ ID NO: 11001 - protein, 949 aa, synthetic construct
  REGION 1..949: note = ARMAN Cas9 variant__Candidatus Micrarchaeum sp.__OJT94500.1__Cas9
MRDSITAPRYSSALAARIKEFNSAFKLGIDLGTKTGGVALVKDNKVLLAKTFLDYHKQTLEERRIHRRNRRSRLARRKRIARLRSWILRQKIYGKQLPDPYKIKKMQLPNGVRKGENWIDLVVSGRDLSPEAFVRAITLIFQKRGQRYEEVAKEIEEMSYKEFSTHIKALTSVTEEEFTALAAEIERRQDVVDTDKEAERYTQLSELLSKVSESKSESKDRAQRKEDLGKVVNAFCSAHRIEDKDKWCKELMKLLDRPVRHARFLNKVLIRCNICDRATPKKSRPDVRELLYFDTVRNFLKAGRVEQNPDVISYYKKIYMDAEVIRVKILNKEKLTDEDKKQKRKLASELNRYKNKEYVTDAQKKMQEQLKTLLFMKLTGRSRYCMAHLKERAAGKDVEEGLHGVVQKRHDRNIAQRNHDLRVINLIESLLFDPNKSLSDAIRKNGLMYVTIEAPEPKTKHAKKGAAVVRDPRKLKEKLFDDQNGVCIYTGLQLDKLEISKYEKDHIFPDSRDGPSIRDNLVLTTKEINSDKGDRTPWEWMHDNPEKWKAFERRVAEFYKKGRINERKRELLLNKGTEYPGDNPTELARGGARVNNFITEFNDRLKTHGVQELQTIFERNKPIVQVVRGEETQRLRRQWNALNQNFIPLKDRAMSFNHAEDAAIAASMPPKFWREQIYRTAWHFGPSGNERPDFALAELAPQWNDFFMTKGGPIIAVLGKTKYSWKHSIIDDTIYKPFSKSAYYVGIYKKPNAITSNAIKVLRPKLLNGEHTMSKNAKYYHQKIGNERFLMKSQKGGSIITVKPHDGPEKVLQISPTYECAVLTKHDGKIIVKFKPIKPLRDMYARGVIKAMDKELETSLSSMSKHAKYKELHTHDIIYLPATKKHVDGYFIITKLSAKHGIKALPESMVKVKYTQIGSENNSEVKLTKPKPEITLDSEDITNIYNFTR

SEQ ID NO: 11002 - protein, 986 aa, synthetic construct
  REGION 1..986: note = CasX variant__Deltaproteobacteria bacterium__OGP07438.1__CasX
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 11003 - protein, 978 aa, synthetic construct
  REGION 1..978: note = CasX variant__Planctomycetes bacterium__OHB99618.1__CasX
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 11004 - protein, 1125 aa, synthetic construct
  REGION 1..1125: note = CasY variant__Candidatus Katanobacteria bacterium__OJI08769.1__CasY
MRKKLFKGYILHNKRLVYTGKAAIRSIKYPLVAPNKTALNNLSEKIIYDYEHLFGPLNVASYARNSNRYSLVDFWIDSLRAGVIWQSKSTSLIDLISKLEGSKSPSEKIFEQIDFELKNKLDKEQFKDIILLNTGIRSSSNVRSLRGRFLKCFKEEFRDTEEVIACVDKWSKDLIVEGKSILVSKQFLYWEEEFGIKIFPHFKDNHDLPKLTFFVEPSLEFSPHLPLANCLERLKKFDISRESLLGLDNNFSAFSNYFNELFNLLSRGEIKKIVTAVLAVSKSWENEPELEKRLHFLSEKAKLLGYPKLTSSWADYRMIIGGKIKSWHSNYTEQLIKVREDLKKHQIALDKLQEDLKKVVDSSLREQIEAQREALLPLLDTMLKEKDFSDDLELYRFILSDFKSLLNGSYQRYIQTEEERKEDRDVTKKYKDLYSNLRNIPRFFGESKKEQFNKFINKSLPTIDVGLKILEDIRNALETVSVRKPPSITEEYVTKQLEKLSRKYKINAFNSNRFKQITEQVLRKYNNGELPKISEVFYRYPRESHVAIRILPVKISNPRKDISYLLDKYQISPDWKNSNPGEVVDLIEIYKLTLGWLLSCNKDFSMDFSSYDLKLFPEAASLIKNFGSCLSGYYLSKMIFNCITSEIKGMITLYTRDKFVVRYVTQMIGSNQKFPLLCLVGEKQTKNFSRNWGVLIEEKGDLGEEKNQEKCLIFKDKTDFAKAKEVEIFKNNIWRIRTSKYQIQFLNRLFKKTKEWDLMNLVLSEPSLVLEEEWGVSWDKDKLLPLLKKEKSCEERLYYSLPLNLVPATDYKEQSAEIEQRNTYLGLDVGEFGVAYAVVRIVRDRIELLSWGFLKDPALRKIRERVQDMKKKQVMAVFSSSSTAVARVREMAIHSLRNQIHSIALAYKAKIIYEISISNFETGGNRMAKIYRSIKVSDVYRESGADTLVSEMIWGKKNKQMGNHISSYATSYTCCNCARTPFELVIDNDKEYEKGGDEFIFNVGDEKKVRGFLQKSLLGKTIKGKEVLKSIKEYARPPIREVLLEGEDVEQLLKRRGNSYIYRCPFCGYKTDADIQAALNIACRGYISDNAKDAVKEGERKLDYILEVRKLWEKNGAVLRSAKFL

SEQ ID NO: 11005 - protein, 1287 aa, synthetic construct
  REGION 1..1287: note = CasY variant__Candidatus Kerfeldbacteria bacterium__OGY82221.1__CasY
MKRILNSLKVAALRLLFRGKGSELVKTVKYPLVSPVQGAVEELAEAIRHDNLHLFGQKEIVDLMEKDEGTQVYSVVDFWLDTLRLGMFFSPSANALKITLGKFNSDQVSPFRKVLEQSPFFLAGRLKVEPAERILSVEIRKIGKRENRVENYAADVETCFIGQLSSDEKQSIQKLANDIWDSKDHEEQRMLKADFFAIPLIKDPKAVTEEDPENETAGKQKPLELCVCLVPELYTRGFGSIADFLVQRLTLLRDKMSTDTAEDCLEYVGIEEEKGNGMNSLLGTFLKNLQGDGFEQIFQFMLGSYVGWQGKEDVLRERLDLLAEKVKRLPKPKFAGEWSGHRMFLHGQLKSWSSNFFRLFNETRELLESIKSDIQHATMLISYVEEKGGYHPQLLSQYRKLMEQLPALRTKVLDPEIEMTHMSEAVRSYIMIHKSVAGFLPDLLESLDRDKDREFLLSIFPRIPKIDKKTKEIVAWELPGEPEEGYLFTANNLFRNFLENPKHVPRFMAERIPEDWTRLRSAPVWFDGMVKQWQKVVNQLVESPGALYQFNESFLRQRLQAMLTVYKRDLQTEKFLKLLADVCRPLVDFFGLGGNDIIFKSCQDPRKQWQTVIPLSVPADVYTACEGLAIRLRETLGFEWKNLKGHEREDFLRLHQLLGNLLFWIRDAKLVVKLEDWMNNPCVQEYVEARKAIDLPLEIFGFEVPIFLNGYLFSELRQLELLLRRKSVMTSYSVKTTGSPNRLFQLVYLPLNPSDPEKKNSNNFQERLDTPTGLSRRFLDLTLDAFAGKLLTDPVTQELKTMAGFYDHLFGFKLPCKLAAMSNHPGSSSKMVVLAKPKKGVASNIGFEPIPDPAHPVFRVRSSWPELKYLEGLLYLPEDTPLTIELAETSVSCQSVSSVAFDLKNLTTILGRVGEFRVTADQPFKLTPIIPEKEESFIGKTYLGLDAGERSGVGFAIVTVDGDGYEVQRLGVHEDTQLMALQQVASKSLKEPVFQPLRKGTFRQQERIRKSLRGCYWNFYHALMIKYRAKVVHEESVGSSGLVGQWLRAFQKDLKKADVLPKKGGKNGVDKKKRESSAQDTLWGGAFSKKEEQQIAFEVQAAGSSQFCLKCGWWFQLGMREVNRVQESGVVLDWNRSIVTFLIESSGEKVYGFSPQQLEKGFRPDIETFKKMVRDFMRPPMFDRKGRPAAAYERFVLGRRHRRYRFDKVFEERFGRSALFICPRVGCGNFDHSSEQSAVVLALIGYIADKEGMSGKKLVYVRLAELMAEWKLKKLERSRVEEQSSAQ

SEQ ID NO: 11006 - protein, 1192 aa, synthetic construct
  REGION 1..1192: note = CasY variant__Candidatus Komeilibacteria bacterium__OJI06454.1__CasY
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDRGVAEKIEQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPAGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWSTYWEKRKPEDILGISTQVYWTGGIGESCPAVAVALLGHIRATSTQTEWEKEEVVFGRLKKFFPS

SEQ ID NO: 11007 - protein, 1210 aa, synthetic construct
  REGION 1..1210: note = CasY variant__Candidatus Parcubacteria bacterium__APG80656.1__CasY
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 11008 - protein, 1226 aa, synthetic construct
  REGION 1..1226: note = CasY variant__Candidatus Vogelbacteria bacterium__OJI07455.1__CasY
MQKVRKTLSEVHKNPYGTKVRNAKTGYSLQIERLSYTGKEGMRSFKIPLENKNKEVFDEFVKKIRNDYISQVGLLNLSDWYEHYQEKQEHYSLADFWLDSLRAGVIFAHKETEIKNLISKIRGDKSIVDKFNASIKKKHADLYALVDIKALYDFLTSDARRGLKTEEEFFNSKRNTLFPKFRKKDNKAVDLWVKKFIGLDNKDKLNFTKKFIGFDPNPQIKYDHTFFFHQDINFDLERITTPKELISTYKKFLGKNKDLYGSDETTEDQLKMVLGFHNNHGAFSKYFNASLEAFRGRDNSLVEQIINNSPYWNSHRKELEKRIIFLQVQSKKIKETELGKPHEYLASFGGKFESWVSNYLRQEEEVKRQLFGYEENKKGQKKFIVGNKQELDKIIRGTDEYEIKAISKETIGLTQKCLKLLEQLKDSVDDYTLSLYRQLIVELRIRLNVEFQETYPELIGKSEKDKEKDAKNKRADKRYPQIFKDIKLIPNFLGETKQMVYKKFIRSADILYEGINFIDQIDKQITQNLLPCFKNDKERIEFTEKQFETLRRKYYLMNSSRFHHVIEGIINNRKLIEMKKRENSELKTFSDSKFVLSKLFLKKGKKYENEVYYTFYINPKARDQRRIKIVLDINGNNSVGILQDLVQKLKPKWDDIIKKNDMGELIDAIEIEKVRLGILIALYCEHKFKIKKELLSLDLFASAYQYLELEDDPEELSGTNLGRFLQSLVCSEIKGAINKISRTEYIERYTVQPMNTEKNYPLLINKEGKATWHIAAKDDLSKKKGGGTVAMNQKIGKNFFGKQDYKTVFMLQDKRFDLLTSKYHLQFLSKTLDTGGGSWWKNKNIDLNLSSYSFIFEQKVKVEWDLTNLDHPIKIKPSENSDDRRLFVSIPFVIKPKQTKRKDLQTRVNYMGIDIGEYGLAWTIINIDLKNKKINKISKQGFIYEPLTHKVRDYVATIKDNQVRGTFGMPDTKLARLRENAITSLRNQVHDIAMRYDAKPVYEFEISNFETGSNKVKVIYDSVKRADIGRGQNNTEADNTEVNLVWGKTSKQFGSQIGAYATSYICSFCGYSPYYEFENSKSGDEEGARDNLYQMKKLSRPSLEDFLQGNPVYKTFRDFDKYKNDQRLQKTGDKDGEWKTHRGNTAIYACQKCRHISDADIQASYWIALKQVVRDFYKDKEMDGDLIQGDNKDKRKVNELNRLIGVHKDVPIINKNLITSLDINLL

SEQ ID NO: 11009 - protein, 1200 aa, synthetic construct
  REGION 1..1200: note = CasY variant__Candidatus Vogelbacteria bacterium__OJI09436.1__CasY
MKAKKSFYNQKRKFGKRGYRLHDERIAYSGGIGSMRSIKYELKDSYGIAGLRNRIADATISDNKWLYGNINLNDYLEWRSSKTDKQIEDGDRESSLLGFWLEALRLGFVFSKQSHAPNDFNETALQDLFETLDDDLKHVLDRKKWCDFIKIGTPKTNDQGRLKKQIKNLLKGNKREEIEKTLNESDDELKEKINRIADVFAKNKSDKYTIFKLDKPNTEKYPRINDVQVAFFCHPDFEEITERDRTKTLDLIINRFNKRYEITENKKDDKTSNRMALYSLNQGYIPRVLNDLFLFVKDNEDDFSQFLSDLENFFSFSNEQIKIIKERLKKLKKYAEPIPGKPQLADKWDDYASDFGGKLESWYSNRIEKLKKIPESVSDLRNNLEKIRNVLKKQNNASKILELSQKIIEYIRDYGVSFEKPEIIKFSWINKTKDGQKKVFYVAKMADREFIEKLDLWMADLRSQLNEYNQDNKVSFKKKGKKIEELGVLDFALNKAKKNKSTKNENGWQQKLSESIQSAPLFFGEGNRVRNEEVYNLKDLLFSEIKNVENILMSSEAEDLKNIKIEYKEDGAKKGNYVLNVLARFYARFNEDGYGGWNKVKTVLENIAREAGTDFSKYGNNNNRNAGRFYLNGRERQVFTLIKFEKSITVEKILELVKLPSLLDEAYRDLVNENKNHKLRDVIQLSKTIMALVLSHSDKEKQIGGNYIHSKLSGYNALISKRDFISRYSVQTTNGTQCKLAIGKGKSKKGNEIDRYFYAFQFFKNDDSKINLKVIKNNSHKNIDFNDNENKINALQVYSSNYQIQFLDWFFEKHQGKKTSLEVGGSFTIAEKSLTIDWSGSNPRVGFKRSDTEEKRVFVSQPFTLIPDDEDKERRKERMIKTKNRFIGIDIGEYGLAWSLIEVDNGDKNNRGIRQLESGFITDNQQQVLKKNVKSWRQNQIRQTFTSPDTKIARLRESLIGSYKNQLESLMVAKKANLSFEYEVSGFEVGGKRVAKIYDSIKRGSVRKKDNNSQNDQSWGKKGINEWSFETTAAGTSQFCTHCKRWSSLAIVDIEEYELKDYNDNLFKVKINDGEVRLLGKKGWRSGEKIKGKELFGPVKDAMRPNVDGLGMKIVKRKYLKLDLRDWVSRYGNMAIFICPYVDCHHISHADKQAAFNIAVRGYLKSVNPDRAIKHGDKGLSRDFLCQEEGKLNFEQIGLL

SEQ ID NO: 11010 - protein, 1153 aa, synthetic construct
  REGION 1..1153: note = CasY variant__Candidatus Vogelbacteria bacterium__PIP58309.1__CasY
MQKVRKTLSEVHKNPYGTKVRNAKTGYSLQIERLSYTGKEGMRSFKIPLENKNKEVFDEFVKKIRNDYISQVGLLNLSDWYEHYQEKQEHYSLADFWLDSLRAGVIFAHKETEIKNLISKIRGDKSIVDKFNASIKKKHADLYALVDIKALYDFLTSDARRGLKTEEEFFNSKRNTLFPKFRKKDNKAVDLWVKKFIGLDNKDKLNFTKKFIGFDPNPQIKYDHTFFFHQDINFDLERITTPKELISTYKKFLGKNKDLYGSDETTEDQLKMVLGFHNNHGAFSKYFNASLEAFRGRDNSLVEQIINNSPYWNSHRKELEKRIIFLQVQSKKIKETELGKPHEYLASFGGKFESWVSNYLRQEEEVKRQLFGYEENKKGQKKFIVGNKQELDKIIRGTDEYEIKAISKETIGLTQKCLKLLEQLKDSVDDYTLSLYRQLIVELRIRLNVEFQETYPELIGKSEKDKEKDAKNKRADKRYPQIFKDIKLIPNFLGETKQMVYKKFIRSADILYEGINFIDQIDKQITQNLLPCFKNDKERIEFTEKQFETLRRKYYLMNSSRFHHVIEGIINNRKLIEMKKRENSELKTFSDSKFVLSKLFLKKGKKYENEVYYTFYINPKARDQRRIKIVLDINGNNSVGILQDLVQKLKPKWDDIIKKNDMGELIDAIEIEKVRLGILIALYCEHKFKIKKELLSLDLFASAYQYLELEDDPEELSGTNLGRFLQSLVCSEIKGAINKISRTEYIERYTVQPMNTEKNYPLLINKEGKATWHIAAKDDLSKKKGGGTVAMNQKIGKNFFGKQDYKTVFMLQDKRFDLLTSKYHLQFLSKTLDTGGGSWWKNKNIDLNLSSYSFIFEQKVKVEWDLTNLDHPIKIKPSENSDDRRLFVSIPFVIKPKQTKRKDLQTRVNYMGIDIGEYGLAWTIINIDLKNKKINKISKQGFIYEPLTHKVRDYVATIKDNQVRGTFGMPDTKLARLRENAITSLRNQVHDIAMRYDAKPVYEFEISNFETGSNKVKVIYDSVKRADIGRGQNNTEADNTEVNLVWGKTSKQFGSQIGAYATSYICSFCGYSPYYEFENSKSGDEEGARDNLYQMKKLSRPSLEDFLQGNPVYKTFRDFDKYKNDQRLQKTGDKDGEWKTHRGNTAIYACQKC

SEQ ID NO: 11011 - RNA, 3480 nt, synthetic construct
  misc_feature 1..3480: note = Cas13a variant__Leptotrichia buccalis__WP_015770004.1__Cas13a
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11012 - RNA, 3480 nt, synthetic construct
  misc_feature 1..3480: note = Cas13a variant__Leptotrichia buccalis__WP_015770004.1__Cas13a(R472A,H477A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatcgctcacggtattgtcgccttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11013 - RNA, 3480 nt, synthetic construct
  misc_feature 1..3480: note = Cas13a variant__Leptotrichia buccalis__WP_015770004.1__Cas13a(R1048A,H1053A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattgctaattacatcgccgcattcaattatattcctcacgccgagatctcactgctggaagtccttgaaaatttgcgtaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11014 - RNA, 3480 nt, synthetic construct
  misc_feature 1..3480: note = Cas13a variant__Leptotrichia buccalis__WP_015770004.1__Cas13a(R472A,H477A,R1048A,H1053A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatcgctcacggtattgtcgccttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattgctaattacatcgccgcattcaattatattcctcacgccgagatctcactgctggaagtccttgaaaatttgcgtaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11015 - RNA, 3480 nt, synthetic construct
  misc_feature 1..3480: note = Cas13a variant__Leptotrichia buccalis__WP_015770004.1__Cas13a(R1079A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgcaattacatcgcccacttcaattatattcctcacgccgagatctcactgctggaagtccttgaaaatttgcgtaaattgctgtcctacgatgccaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11016 - RNA, 3480 nt, synthetic construct
  misc_feature 1..3480: note = Cas13a variant__Leptotrichia buccalis__WP_015770004.1__Cas13a(E299A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgccatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11017 - RNA, 3480 nt, synthetic construct
  misc_feature 1..3480: note = Cas13a variant__Leptotrichia buccalis__WP_015770004.1__Cas13a(K310A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatatgcccgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11018 - RNA, 3480 nt, synthetic construct
  misc_feature 1..3480: note = Cas13a variant__Leptotrichia buccalis__WP_015770004.1__Cas13a(N314A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtgcaatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgcaattacatcgcccacttcaattatattcctcacgccgagatctcactgctggaagtccttgaaaatttgcgtaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11019 - RNA, 3480 nt, synthetic construct
  misc_feature 1..3480: note = Cas13a variant__Leptotrichia buccalis__WP_015770004.1__Cas13a(R1072A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttggcaaaattgctgtcctacgatcgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11020 - RNA, 3480 nt, synthetic construct
  misc_feature 1..3480: note = Cas13a variant__Leptotrichia buccalis__WP_015770004.1__Cas13a(D1078A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgcacgcaaactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11021 - RNA, 3480 nt, synthetic construct
  misc_feature 1..3480: note = Cas13a variant__Leptotrichia buccalis__WP_015770004.1__Cas13a(R1079A,K1080A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatgccgcactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11022 - RNA, 3480 nt, synthetic construct
  misc_feature 1..3480: note = Cas13a variant__Leptotrichia buccalis__WP_015770004.1__Cas13a(K1080A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatcgcgcactgaaaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11023 - RNA, 3480 nt, synthetic construct
  misc_feature 1..3480: note = Cas13a variant__Leptotrichia buccalis__WP_015770004.1__Cas13a(K1082A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatcgcaaactggcaaatgccgtaatgaaatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11024 - RNA, 3480 nt, synthetic construct
  misc_feature 1..3480: note = Cas13a variant__Leptotrichia buccalis__WP_015770004.1__Cas13a(K1087A)
  source 1..3480: mol_type = other RNA
atgaaagtgacgaaggtaggaggcatttcgcataagaagtacacgtccgaaggccgcttagtgaagtcagaatcggaagaaaatcgcacagacgaacgtctgtcggcgttgcttaatatgcgccttgacatgtatatcaagaatcccagcagcacggaaaccaaggaaaatcaaaaacgcattgggaaattaaagaaattcttctcaaacaaaatggtctatcttaaagacaataccttgagtttgaagaatgggaaaaaggagaacattgatcgtgagtattctgagactgacatccttgagagcgatgtccgtgacaagaaaaacttcgccgtgttgaaaaagatctatctgaatgaaaacgtgaactcggaggaattggaagtttttcgtaacgacattaagaagaaactgaacaaaatcaacagcctgaagtactcatttgaaaagaataaggcgaattatcaaaagattaatgagaataacatcgagaaggttgaaggtaagtcaaagcgtaacattatttacgattattatcgtgagtcagcgaaacgtgacgcttatgtaagcaatgtgaaagaagcctttgataagctttacaaggaagaggacattgcaaaacttgttcttgaaattgagaaccttacgaagttagagaaatacaagattcgcgagttctaccacgaaattattggacgtaagaatgacaaggaaaactttgcaaaaatcatctacgaagaaatccagaatgttaataacatgaaagagttgatcgagaaggtaccggacatgagtgagttgaaaaagagccaagtattttacaagtattacttagacaaagaagagttgaacgacaagaacatcaaatacgcgttttgtcatttcgtggaaatcgaaatgagtcagttgctgaagaactacgtatataagcgcttaagtaatatctcgaatgacaaaattaagcgtatctttgaataccagaacttgaaaaaattgatcgaaaataagctgttaaacaaacttgacacgtacgtccgtaattgtggaaagtataattattatttgcaagacggcgaaattgccacttcagatttcatcgcccgcaaccgtcagaatgaagcgtttcttcgcaacatcattggggtgtcatctgtggcctacttttctcttcgcaacattcttgaaacggagaacgagaatgatattactgggcgtatgcgcggcaaaacagttaagaacaataaaggtgaagagaagtacgtgtccggagaagttgataagatctataatgaaaataagaagaacgaggttaaggagaacttaaaaatgttctattcgtacgatttcaatatggacaacaagaatgaaatcgaagatttcttcgccaacatcgacgaggcgatttcttccatccgtcacggtattgtccacttcaacttggaattagaaggtaaggatatctttgcgttcaagaacattgcgccatccgaaatctcaaagaagatgtttcagaatgagattaacgagaaaaaactgaaattgaagatctttcgtcaactgaactctgccaacgtgttccgctatctcgaaaagtataaaattctgaattaccttaaacgtacacgcttcgagtttgtcaataaaaatatcccattcgtcccgtctttcaccaaattatattcgcgcattgatgacctgaagaatagtcttgggatttactggaaaactccgaaaacaaacgacgacaataagactaaggagattattgatgcccaaatctatttgcttaaaaacatctattacggggagttcctgaattatttcatgtcgaacaatggtaatttctttgagatttctaaagaaatcatcgaattgaacaagaacgataaacgcaacttaaagactgggttttacaagctgcaaaagtttgaagacatccaggagaagattccaaaggaatacttggcgaatatccagtccctgtacatgattaatgccggtaatcaggacgaagaagaaaaggacacttatattgatttcattcaaaagatcttcttaaagggatttatgacgtatcttgctaataacggtcgtttaagtctgatttacatcggctcggatgaagaaacaaatacgtcattagcagaaaagaagcaagagtttgacaagttcttgaagaagtacgagcagaacaataatatcaagatcccctatgagatcaatgaattcctgcgtgagatcaaactgggaaacatcctgaagtatactgagcgtttaaacatgttctaccttatcttaaagcttttgaatcacaaggagctgacaaatctgaagggtagtcttgaaaaatatcagtctgccaataaggaagaagcgttctctgaccaattggagttaattaacctgcttaaccttgacaacaaccgcgtgacggaagacttcgaattagaggccgacgagattggaaaatttcttgatttcaatggcaacaaagttaaggataacaaggaactgaaaaagttcgatacaaacaagatctactttgacggcgagaacattatcaaacaccgtgccttctacaatattaagaaatatggcatgttaaacttactggagaaaattgccgacaaggctggatacaagatctcgatcgaagagctgaagaaatactccaataaaaagaatgagatcgagaagaaccataagatgcaggaaaatctgcaccgcaaatacgctcgtccccgtaaagacgagaagtttacagatgaggactatgaaagttacaagcaagctattgagaatattgaggagtacacccaccttaagaacaaggtagaattcaatgagctgaatttactgcagggcctgttgctgcgcattttacatcgtttagtcggatatacctcaatttgggaacgcgatctgcgcttccgccttaaaggtgagttcccagaaaaccaatacatcgaagagatcttcaactttgaaaataagaagaacgtgaagtacaaagggggtcagattgtagagaaatacattaaattctacaaggaattacatcaaaatgatgaagttaagatcaacaagtacagttccgcgaatatcaaggtgttgaagcaagaaaagaaggacctttatattcgaaattacatcgcccacttcaattatattcctcacgccgagatctcactgctggaagtccttgaaaatttgcgtaaattgctgtcctacgatcgcaaactgaaaaatgccgtaatggcatcagtagttgatatccttaaggagtatggttttgtagccacattcaaaatcggggcggacaagaagatcggtattcagacactggagagcgaaaaaatcgtgcatcttaagaatcttaagaagaagaagttaatgactgaccgcaattccgaggaactttgcaaattggtgaagattatgtttgaatacaaaatggaagagaaaaagtctgaaaactaa

SEQ ID NO: 11025 - RNA, 4170 nt, synthetic construct
  misc_feature 1..4170: note = Cas13a variant__Leptotrichia shahii__WP_018451595.1__Cas13a
  source 1..4170: mol_type = other RNA
atggggaaccttttcgggcataaacgctggtacgaggtgcgcgataagaaggactttaagatcaaacgcaaagtcaaggttaagcgtaattacgacggtaacaaatacatcttaaacatcaacgagaacaacaataaggagaaaatcgacaataacaagtttattcgtaagtacatcaattacaagaaaaacgacaatatccttaaagaatttacgcgcaaattccatgcaggcaatatcttgttcaagttaaagggtaaggaggggatcattcgtatcgagaacaatgatgactttctggaaactgaagaggttgtcctttacatcgaagcgtatgggaagagcgagaagctgaaagctctgggaatcactaaaaaaaaaatcattgacgaggcgattcgtcaaggcatcacaaaggatgacaagaaaatcgaaatcaagcgccaagagaacgaagaagaaatcgaaatcgacatccgcgatgaatacaccaacaagaccttaaatgattgcagtattattctgcgcatcattgaaaacgatgagcttgagacgaaaaagtctatctatgagatctttaagaatatcaacatgtcgttgtacaagattatcgagaagattattgaaaatgagactgagaaagtctttgaaaaccgttattatgaagagcaccttcgcgaaaaactgcttaaggacgacaaaattgatgttattctgactaactttatggagattcgtgagaagatcaagagcaacctggaaattttagggttcgtcaaattctacttaaacgtagggggggataaaaagaagtccaaaaacaagaagatgttggtggagaaaatcttaaacatcaatgtagacctgaccgtggaggacattgctgattttgttattaaggagttggagttttggaacatcacaaaacgcattgaaaaagttaagaaagttaataacgagtttttagaaaagcgtcgcaaccgcacgtatatcaaatcatacgtccttttagataagcacgaaaaatttaagatcgagcgcgaaaacaagaaagataaaattgtcaaatttttcgtcgagaatatcaagaacaatagcatcaaggagaagatcgaaaagatcttggcggaatttaaaatcgacgaattgatcaaaaaattagagaaagagttaaagaaaggtaactgcgatacagagatcttcggtatcttcaagaaacactataaggtcaattttgactccaagaagttctccaagaaatctgacgaggaaaaggaattgtataagattatctatcgctaccttaaaggacgcatcgagaagattctggtcaacgaacagaaggtacgcttaaagaagatggagaaaatcgaaattgagaagattttaaacgaatctatcctttcggaaaaaatccttaagcgcgtcaagcagtacaccctggaacacatcatgtacttgggaaaacttcgtcataatgatattgatatgacgactgtcaatactgatgatttttctcgcttacatgcgaaagaagagctggacttggagttgattacgtttttcgcatctacgaacatggaactgaacaagattttctctcgcgagaatattaataacgacgaaaatattgacttctttggaggtgaccgcgaaaagaactatgtgctcgacaagaaaattctcaactctaagattaagatcattcgcgatcttgatttcatcgacaataagaacaacattacgaataactttattcgcaagtttaccaagattggtacgaatgagcgcaatcgtattttgcacgccattagtaaagaacgtgatttgcagggaacgcaagacgactataacaaggtaatcaacatcattcaaaacttgaagatctccgacgaagaagtatcaaaagccttgaatttggatgtcgtgttcaaggataagaagaacattatcacaaaaatcaacgatattaaaatcagtgaggagaataacaacgatattaaatatttaccgagttttagcaaggttctgccggaaatcttaaatttataccgcaataatcctaaaaacgaacccttcgatacaattgagactgaaaagatcgtgttgaacgctcttatttatgtgaacaaagaattgtacaagaagttaatcctggaggatgacctggaagagaacgagagcaaaaacattttcttgcaggagctgaagaaaaccttaggtaatattgatgagatcgacgagaacatcattgagaattactacaagaacgcccaaatctcggcgtctaaaggaaataataaggcgattaagaaataccagaagaaagttatcgaatgctacatcgggtatttgcgtaagaactacgaagagcttttcgacttttcggactttaagatgaacatccaagagattaagaaacaaatcaaggatattaatgacaataagacgtatgagcgtattacagtgaaaaccagtgacaagactatcgtaattaacgacgattttgagtacatcatttcaatctttgcgttgttgaactctaatgccgtaatcaacaagattcgcaaccgtttcttcgcgacgtcagtgtggctgaacacctcagagtaccagaatattatcgatatcctggacgagattatgcagctgaatacgctgcgtaacgagtgtattaccgaaaactggaacctcaacttagaagagtttatccaaaagatgaaggaaatcgagaaggactttgatgattttaaaattcagacaaagaaggagatctttaacaactattacgaggacatcaaaaacaacatcttaacggaatttaaagacgatattaacggttgcgacgtgcttgaaaagaagttggagaaaatcgtaatctttgacgacgaaaccaagtttgagatcgacaagaagtccaatattttgcaggacgagcagcgtaaattgagcaatatcaataagaaggacctgaaaaagaaggtggaccaatatattaaagacaaggatcaggaaatcaaatcgaagattttgtgccgtattatcttcaactcagacttccttaagaaatataagaaggaaattgacaatttgatcgaagatatggagtctgagaatgagaacaagttccaagagatttattacccgaaagagcgcaagaacgaactctatatctataagaaaaacttgttcttaaatattggaaacccaaactttgacaagatttatggccttatttcgaacgatattaagatggccgatgctaaattcttgtttaatatcgatggtaagaatattcgtaaaaataagattagtgaaattgacgccattttgaagaaccttaacgacaagctgaacggctactcgaaagagtacaaggagaagtatatcaaaaagttgaaggaaaacgatgacttctttgccaaaaatatccagaacaaaaattacaagagcttcgaaaaggattacaaccgcgtttctgagtataaaaagatccgcgaccttgtagagttcaactatttaaacaaaatcgaatcttacttaatcgatatcaactggaaattggcgattcaaatggcccgctttgagcgcgacatgcactatatcgtaaatgggttgcgcgagttgggaattatcaagttgtcaggatataacacggggatctcacgtgcatacccaaagcgcaatggatcagacgggttttacacaaccactgcttactataagttctttgatgaggaatcctacaagaaattcgaaaagatctgttacggtttcggtatcgacttgagcgaaaacagcgagatcaacaagccagaaaatgaatccattcgcaactatatttctcacttttatatcgttcgcaacccgtttgcagactactctattgcggagcagatcgaccgtgtgtcgaatttgctgagttatagcacccgctataacaactcgacgtatgcatcagtattcgaggtctttaaaaaggacgtgaaccttgactatgatgaattaaagaaaaaattcaagcttattggcaataatgacatcttggaacgcttgatgaagccgaagaaagtctccgtacttgaattagaatcgtacaactctgattacatcaagaacctgatcattgagttattgactaagattgaaaatacaaacgataccctgtaa

SEQ ID NO: 11026 - RNA, 4170 nt, synthetic construct
  misc_feature 1..4170: note = Cas13a variant__Leptotrichia shahii__WP_018451595.1__Cas13a
  source 1..4170: mol_type = other RNA
atggggaacctgttcggacacaagcggtggtacgaggtgcgagataagaaagacttcaagatcaagcgaaaggtgaaagtcaagcggaattatgacgggaacaagtacattctgaacatcaacgaaaacaacaacaaagagaagatcgacaacaacaagttcatcagaaagtacatcaactacaagaaaaacgataatattctgaaggagttcactaggaaatttcatgcaggaaatatcctgttcaaactgaagggcaaagaagggatcattagaattgagaataacgacgacttcctggagacagaggaagtggtgctgtatatcgaggcctacggcaagagcgagaagctgaaagcactggggatcacaaagaaaaagatcattgacgaggccatcaggcagggcattactaaggacgataaaaagatcgagatcaagcgacaggagaacgaggaagagatcgaaattgacatccgggatgagtacactaataagaccctgaacgactgctccatcattctgcgcatcattgaaaacgatgaactggagacaaagaagagcatctacgagatcttcaagaacatcaatatgagcctgtataagatcatcgagaagatcatcgaaaacgagacagaaaaggtgtttgaaaatagatactacgaagagcacctgagggagaagctgctgaaagacgataagattgacgtgatcctgaccaacttcatggaaatccgggagaagatcaagtctaatctggagatcctgggcttcgtgaagttttacctgaacgtcggcggggacaaaaagaaaagtaaaaataagaaaatgctggtggaaaagattctgaacatcaatgtggatctgaccgtcgaggacattgccgatttcgtgatcaaggagctggaattttggaacatcacaaagcgcattgagaaagtgaagaaagtcaataacgagttcctggagaagcggagaaatcggacatacatcaagtcctatgtgctgctggacaagcacgaaaagtttaaaatcgagagagaaaacaagaaggataagatcgtgaagttctttgtcgagaacattaagaacaactctatcaaggaaaagattgagaagatcctggctgagttcaagatcgacgagctgattaagaaactggagaaggaactgaagaaagggaactgtgataccgagatcttcggaatctttaagaagcattacaaggtgaacttcgacagcaagaaattttccaagaaatctgatgaagagaaggagctgtataagatcatctacagatacctgaagggcagaattgaaaaaatcctggtgaacgagcagaaggtcagactgaagaaaatggagaagatcgagatcgaaaagattctgaatgaaagtatcctgtcagagaaaattctgaagagagtgaaacagtatacactggagcacattatgtacctggggaagctgaggcataacgacatcgatatgaccacagtgaatactgacgatttcagccgcctgcacgccaaggaagagctggacctggaactgatcaccttctttgccagcacaaatatggagctgaacaagatcttttcccgagaaaacatcaacaacgacgagaacatcgatttctttggaggcgaccgggagaagaactatgtgctggataagaaaatcctgaatagtaagatcaagatcatccgcgacctggatttcatcgataacaagaacaacatcacaaacaacttcattcgaaagtttacaaagatcggcactaatgaaaggaaccgcatcctgcatgccatttccaaagagagggacctgcaggggactcaggacgattacaacaaagtgatcaacatcattcagaatctgaagatctccgatgaagaggtgagcaaagctctgaacctggacgtggtctttaaggacaagaaaaacatcatcacaaagatcaatgacatcaagatctctgaagagaacaacaacgatatcaagtatctgcccagcttcagcaaagtgctgcccgaaatcctgaacctgtaccgcaacaatcccaagaatgagccttttgacacaatcgagactgaaaaaattgtgctgaacgctctgatctacgtcaataaggagctgtataagaaactgatcctggaggacgatctggaagagaacgagtccaagaatatcttcctgcaggaactgaagaaaaccctgggcaacattgacgaaatcgatgagaacatcatcgagaactactacaagaacgcacagatttctgccagtaaggggaacaacaaggcaatcaagaaatatcagaagaaagtgatcgagtgctacattggatatctgcgcaaaaactacgaagagctgttcgacttttcagacttcaagatgaacatccaggaaatcaagaaacagattaaggacatcaacgataacaagacttatgagcggatcaccgtgaaaaccagcgacaaaaccattgtcatcaacgacgatttcgagtacatcatttctatctttgcactgctgaacagtaatgccgtgattaataagatccgaaacagattcttcgccaccagcgtgtggctgaacacctcagaataccagaatatcattgacatcctggatgagattatgcagctgaataccctgcggaacgaatgcatcacagagaactggaatctgaacctggaagagttcattcagaagatgaaagagatcgaaaaggatttcgacgacttcaagatccagactaagaaagaaatcttcaacaactactacgaggacatcaagaacaacattctgaccgagtttaaagacgatatcaacggctgtgatgtgctggaaaagaaactggagaagattgtcatcttcgacgatgaaaccaagttcgagatcgacaagaaatccaacatcctgcaggatgaacagagaaagctgtctaacatcaacaagaaggacctgaagaaaaaggtggatcagtatatcaaggacaaagatcaggagatcaagtctaaaatcctgtgcaggatcattttcaacagtgactttctgaaaaagtacaagaaggaaatcgacaatctgattgaggatatggagtctgaaaatgagaacaagttccaggagatctactatcccaaggaacggaagaacgagctgtatatctacaaaaagaatctgttcctgaacatcggaaatcctaactttgacaagatctacggcctgattagcaacgacatcaagatggccgatgctaaattcctgtttaatatcgatggaaagaacatcagaaagaacaaaatcagtgagatcgacgctattctgaagaatctgaacgataaactgaacggctactcaaaggaatacaaggagaagtacatcaaaaagctgaaggagaacgacgatttctttgcaaagaacatccagaataagaactacaaatccttcgaaaaggactataaccgcgtgtctgagtacaaaaagattcgagatctggtcgagttcaactatctgaacaaaatcgagtcctacctgattgacatcaactggaagctggctattcagatggcaagattcgaaagggatatgcactatatcgtgaatggactgagggagctgggcatcattaagctgtcaggctataacaccgggatcagcagggcatacccaaagcgcaatggaagcgacggcttttacactaccacagcctactacaagttctttgatgaagagtcctacaagaagttcgagaagatttgctacgggtttggaatcgacctgagcgaaaattccgagatcaacaagcctgaaaatgagagcattcggaactatatctcccatttctacatcgtgagaaatccatttgccgactacagtattgctgagcagatcgatcgggtgagcaacctgctgtcatatagcacacgctacaacaattcaacttatgccagcgtgttcgaagtctttaaaaaggacgtgaatctggactacgatgagctgaaaaagaaattcaaactgatcggcaacaatgatattctggagcgcctgatgaagcccaagaaagtgagcgtcctggaactggagtcctacaacagtgactacattaagaatctgatcattgaactgctgaccaaaatcgagaatactaacgataccctgtga

SEQ ID NO: 11027 - RNA, 4305 nt, synthetic construct
  misc_feature 1..4305: note = Cas13a variant__Leptotrichia shahii__WP_018451595.1__Cas13a(long)
  source 1..4305: mol_type = other RNA
atggggaacctgttcggacacaagcggtggtacgaggtgcgagataagaaagacttcaagatcaagcgaaaggtgaaagtcaagcggaattatgacgggaacaagtacattctgaacatcaacgaaaacaacaacaaagagaagatcgacaacaacaagttcatcagaaagtacatcaactacaagaaaaacgataatattctgaaggagttcactaggaaatttcatgcaggaaatatcctgttcaaactgaagggcaaagaagggatcattagaattgagaataacgacgacttcctggagacagaggaagtggtgctgtatatcgaggcctacggcaagagcgagaagctgaaagcactggggatcacaaagaaaaagatcattgacgaggccatcaggcagggcattactaaggacgataaaaagatcgagatcaagcgacaggagaacgaggaagagatcgaaattgacatccgggatgagtacactaataagaccctgaacgactgctccatcattctgcgcatcattgaaaacgatgaactggagacaaagaagagcatctacgagatcttcaagaacatcaatatgagcctgtataagatcatcgagaagatcatcgaaaacgagacagaaaaggtgtttgaaaatagatactacgaagagcacctgagggagaagctgctgaaagacgataagattgacgtgatcctgaccaacttcatggaaatccgggagaagatcaagtctaatctggagatcctgggcttcgtgaagttttacctgaacgtcggcggggacaaaaagaaaagtaaaaataagaaaatgctggtggaaaagattctgaacatcaatgtggatctgaccgtcgaggacattgccgatttcgtgatcaaggagctggaattttggaacatcacaaagcgcattgagaaagtgaagaaagtcaataacgagttcctggagaagcggagaaatcggacatacatcaagtcctatgtgctgctggacaagcacgaaaagtttaaaatcgagagagaaaacaagaaggataagatcgtgaagttctttgtcgagaacattaagaacaactctatcaaggaaaagattgagaagatcctggctgagttcaagatcgacgagctgattaagaaactggagaaggaactgaagaaagggaactgtgataccgagatcttcggaatctttaagaagcattacaaggtgaacttcgacagcaagaaattttccaagaaatctgatgaagagaaggagctgtataagatcatctacagatacctgaagggcagaattgaaaaaatcctggtgaacgagcagaaggtcagactgaagaaaatggagaagatcgagatcgaaaagattctgaatgaaagtatcctgtcagagaaaattctgaagagagtgaaacagtatacactggagcacattatgtacctggggaagctgaggcataacgacatcgatatgaccacagtgaatactgacgatttcagccgcctgcacgccaaggaagagctggacctggaactgatcaccttctttgccagcacaaatatggagctgaacaagatcttttcccgagaaaacatcaacaacgacgagaacatcgatttctttggaggcgaccgggagaagaactatgtgctggataagaaaatcctgaatagtaagatcaagatcatccgcgacctggatttcatcgataacaagaacaacatcacaaacaacttcattcgaaagtttacaaagatcggcactaatgaaaggaaccgcatcctgcatgccatttccaaagagagggacctgcaggggactcaggacgattacaacaaagtgatcaacatcattcagaatctgaagatctccgatgaagaggtgagcaaagctctgaacctggacgtggtctttaaggacaagaaaaacatcatcacaaagatcaatgacatcaagatctctgaagagaacaacaacgatatcaagtatctgcccagcttcagcaaagtgctgcccgaaatcctgaacctgtaccgcaacaatcccaagaatgagccttttgacacaatcgagactgaaaaaattgtgctgaacgctctgatctacgtcaataaggagctgtataagaaactgatcctggaggacgatctggaagagaacgagtccaagaatatcttcctgcaggaactgaagaaaaccctgggcaacattgacgaaatcgatgagaacatcatcgagaactactacaagaacgcacagatttctgccagtaaggggaacaacaaggcaatcaagaaatatcagaagaaagtgatcgagtgctacattggatatctgcgcaaaaactacgaagagctgttcgacttttcagacttcaagatgaacatccaggaaatcaagaaacagattaaggacatcaacgataacaagacttatgagcggatcaccgtgaaaaccagcgacaaaaccattgtcatcaacgacgatttcgagtacatcatttctatctttgcactgctgaacagtaatgccgtgattaataagatccgaaacagattcttcgccaccagcgtgtggctgaacacctcagaataccagaatatcattgacatcctggatgagattatgcagctgaataccctgcggaacgaatgcatcacagagaactggaatctgaacctggaagagttcattcagaagatgaaagagatcgaaaaggatttcgacgacttcaagatccagactaagaaagaaatcttcaacaactactacgaggacatcaagaacaacattctgaccgagtttaaagacgatatcaacggctgtgatgtgctggaaaagaaactggagaagattgtcatcttcgacgatgaaaccaagttcgagatcgacaagaaatccaacatcctgcaggatgaacagagaaagctgtctaacatcaacaagaaggacctgaagaaaaaggtggatcagtatatcaaggacaaagatcaggagatcaagtctaaaatcctgtgcaggatcattttcaacagtgactttctgaaaaagtacaagaaggaaatcgacaatctgattgaggatatggagtctgaaaatgagaacaagttccaggagatctactatcccaaggaacggaagaacgagctgtatatctacaaaaagaatctgttcctgaacatcggaaatcctaactttgacaagatctacggcctgattagcaacgacatcaagatggccgatgctaaattcctgtttaatatcgatggaaagaacatcagaaagaacaaaatcagtgagatcgacgctattctgaagaatctgaacgataaactgaacggctactcaaaggaatacaaggagaagtacatcaaaaagctgaaggagaacgacgatttctttgcaaagaacatccagaataagaactacaaatccttcgaaaaggactataaccgcgtgtctgagtacaaaaagattcgagatctggtcgagttcaactatctgaacaaaatcgagtcctacctgattgacatcaactggaagctggctattcagatggcaagattcgaaagggatatgcactatatcgtgaatggactgagggagctgggcatcattaagctgtcaggctataacaccgggatcagcagggcatacccaaagcgcaatggaagcgacggcttttacactaccacagcctactacaagttctttgatgaagagtcctacaagaagttcgagaagatttgctacgggtttggaatcgacctgagcgaaaattccgagatcaacaagcctgaaaatgagagcattcggaactatatctcccatttctacatcgtgagaaatccatttgccgactacagtattgctgagcagatcgatcgggtgagcaacctgctgtcatatagcacacgctacaacaattcaacttatgccagcgtgttcgaagtctttaaaaaggacgtgaatctggactacgatgagctgaaaaagaaattcaaactgatcggcaacaatgatattctggagcgcctgatgaagcccaagaaagtgagcgtcctggaactggagtcctacaacagtgactacattaagaatctgatcattgaactgctgaccaaaatcgagaatactaacgataccctgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 11028 - RNA, 4158 nt, synthetic construct
  misc_feature 1..4158: note = Cas13a variant__Leptotrichia sp. oral__WP_021744063.1__Cas13a
  source 1..4158: mol_type = other RNA
atgggaaatttatttggacataagagatggtatgaagttcgtgataaaaaagattttaaaataaaacggaaagtaaaagttaaaaggaactatgatggaaacaaatacattttaaatattaatgaaaataataataaagaaaaaattgataataataaatttattggagaatttgttaattataaaaaaaataataatgttcttaaagaatttaaaaggaaatttcatgcaggaaatattctatttaagttgaaaggtaaagaagaaatcataagaatagaaaataatgatgattttttggaaacagaagaagttgtattatatatagaagtatatggaaaatctgagaaattgaaagcactggagattacaaaaaagaaaataatagatgaagcaattaggcaaggaataactaaagatgataaaaaaatagaaataaagagacaagagaatgaagaagaaatagagatagatatcagagatgagtatactaataaaacactaaatgattgttcaataatattaagaataatagaaaatgatgaattagaaacaaaaaaatcaatttacgaaatttttaaaaatattaacatgagtttatataagattatagaaaaaataattgaaaatgaaacagaaaaagtatttgaaaatcgatattatgaagaacatttaagagaaaaattattgaaagataataaaatagatgttattttgactaattttatggaaataagagaaaaaataaaaagtaatttagaaattatgggttttgtaaaattttatcttaatgttagtggtgataaaaagaaatctgaaaataaaaaaatgtttgttgaaaagattttaaatacaaatgtagatttaacggtagaagatatagtagattttattgtaaaagaattaaaattttggaatattactaaaagaattgaaaaagtaaaaaaatttaataatgaatttcttgaaaatagaagaaatagaacatatataaaatcttatgtactattagataagcacgaaaaatttaaaatagaaagagaaaataaaaaagataaaattgtaaaattttttgtagaaaatataaaaaataatagtataaaagaaaaaatagaaaaaattttagcagaatttaaaataaatgaattaataaaaaaactagaaaaagaactaaaaaaaggaaattgtgatacagaaatttttggaatatttaaaaaacattataaagttaattttgattcgaaaaaattttcaaataaatctgatgaagaaaaagaactatataaaatcatatatcgatatttaaaaggaagaattgaaaaaatattggtaaatgaacaaaaagtcagattaaagaaaatggaaaaaatagaaatagaaaaaattttaaatgaaagtatattatctgaaaaaattttaaaaagagttaagcaatatacgttagagcatattatgtatttagggaaattaagacataatgatatagttaaaatgacagtaaatactgatgatttttctagacttcacgctaaagaagagttggatttagaattgattactttttttgcttctactaatatggaattgaataagatttttaatggaaaagaaaaagtaacagatttttttggctttaatttaaatggccaaaaaattacactaaaagaaaaagttcctagtttcaaattaaatattttaaaaaagttaaattttataaataatgaaaataatattgatgaaaaattatctcatttctattcttttcagaaagaaggatacttattaagaaataaaattttacataattcttatggaaatattcaagaaactaaaaatttaaaaggagaatatgaaaatgttgaaaagttaataaaagaactaaaagttagtgatgaagaaatttctaagtccttaagtttagatgttatatttgaaggtaaagttgatataattaacaaaattaatagtttaaaaataggagaatacaaagataaaaaatatttaccttctttttcaaaaattgttcttgaaataacgagaaaatttagagaaataaataaagataaattgtttgatattgaaagtgaaaaaataatattaaatgcagtgaaatatgttaataaaatattatatgaaaaaataacttcaaatgaagagaacgaatttttaaaaacattacctgacaaattagtaaaaaaaagtaataataaaaaagaaaacaaaaatctattatcaatagaagaatattataaaaatgctcaagtatcatcatcaaaaggagacaaaaaagctataaaaaaatatcaaaacaaagttacaaacgcttatcttgaatatttagagaatacatttacagaaataatagatttttcaaaattcaatttgaattatgatgaaataaaaactaaaattgaagaaagaaaagataataaaagtaaaattattatagattctatttctacaaatataaatataaccaatgatattgagtatataatttcaatatttgcattattaaatagtaacacgtatataaataaaattagaaatagattttttgcaacatcagtttggttagaaaaacaaaacggtaccaaagaatatgattatgaaaatattataagtattttagatgaagttttattaataaatttattaagagaaaataatataactgatattttagatttaaaaaatgcgattatagatgccaaaatagtggagaatgatgaaacatatattaagaattatatttttgaaagtaatgaagaaaaattgaaaaaaagattgttttgtgaagaacttgtcgataaagaagacattcgaaaaatatttgaagatgaaaattttaaatttaaaagtttcataaagaaaaatgaaattggaaattttaagattaattttggtattttatctaacttagagtgtaattctgaagtagaggcaaaaaaaataatagggaaaaattcaaaaaaattagagtcctttatacagaatattattgatgaatataaatcaaacataagaactttattttcatcagaatttctagaaaaatataaggaagaaatagataatttagtagaagatacagaatcagagaataaaaataaatttgaaaaaatatattatcctaaagaacataagaatgaactatatatttataaaaagaatttatttttaaatattgggaatccaaattttgataagatttatggattaatttcaaaagatataaaaaatgttgacacaaaaatattatttgacgacgatattaaaaaaaataaaatatctgaaattgatgcaatattgaaaaatttaaatgataaattgaatggatattctaacgattataaagcaaaatatgtaaacaaattgaaagaaaatgatgatttttttgccaaaaatatacaaaatgaaaattatagttcatttggagaatttgaaaaggattataataaagtttctgagtataaaaaaataagagatttggtagaatttaattatttgaataaaatagaaagttatttgatagatataaattggaaacttgctattcaaatggctagatttgaaagagatatgcactatattgtaaatgggctaagagaattaggaattattaagttaagtggctacaatactggaataagtagagcttatcctaagcgtaatggatctgatggcttttatacaacaacagcatactataaattttttgatgaagaatcttataaaaaatttgagaaaatatgttatggatttggaattgatttgtctgaaaattctgaaattaataagccggaaaatgaaagtattagaaactatatttcacatttctatattgtaagaaatccatttgctgattacagtattgcagaacaaattgatagagtttctaatttattatcatatagtacacgttataataattcaacttatgcaagtgtatttgaagtatttaaaaaagatgtgaatttagattatgatgaattaaagaaaaaatttagacttatcggtaataatgatatacttgaaagattaatgaaacctaaaaaagtttctgttttagaattagaaagttataattctgattatattaaaaacttgataatagaacttttaacaaaaatagaaaatacaaatgatacgttataa

SEQ ID NO: 11029 - RNA, 3459 nt, synthetic construct
  misc_feature 1..3459: note = Cas13a variant__Leptotrichia wadei__WP_021746774.1__Cas13a
  source 1..3459: mol_type = other RNA
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaatga

SEQ ID NO: 11030 - RNA, 3459 nt, synthetic construct
  misc_feature 1..3459: note = Cas13a variant__Leptotrichia wadei__WP_021746774.1__Cas13a(G403D)
  source 1..3459: mol_type = other RNA
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacgatatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagctggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaataa

SEQ ID NO: 11031 - RNA, 3909 nt, synthetic construct
  misc_feature 1..3909: note = Cas13a variant__Leptotrichia wadei__WP_021746774.1__6xHis-Tag/Twin-Strep/SUMO_Cas13a(G40 3D)
  source 1..3909: mol_type = other RNA
atgggcagcagccatcatcatcatcatcacagcagcggcctggtgccgcgcggcagccatatggctagctggagccatccgcagtttgaaaaaggtggtggtagcggtggtggttcaggtggtagtgcatggtcacaccctcagtttgagaaaatgtcggactcagaagtcaatcaagaagctaagccagaggtcaagccagaagtcaagcctgagactcacatcaatttaaaggtgtccgatggatcttcagagatcttcttcaagatcaaaaagaccactcctttaagaaggctgatggaagcgttcgctaaaagacagggtaaggaaatggactccttaagattcttgtacgacggtattagaatccaagctgatcagacccctgaagatttggacatggaggataacgatattattgaggctcacagagaacagattggtggatccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacgatatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaacatcgacgaggccatcagcagcatcagacacggcatcgtgcacttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagctggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggaaaaaaaggacctgtacatccggaactacattgcccacttcaactacatcccccacgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaataa

SEQ ID NO: 11032 - RNA, 3459 nt, synthetic construct
  misc_feature 1..3459: note = Cas13a variant__Leptotrichia wadei__WP_021746774.1__Cas13a(R474A,R1046A)
  source 1..3459: mol_type = other RNA
atgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaatatcgatgaggccatctctagtattgctcacggcatcgtgcatttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggagaagaaagacctgtatattgcaaactacatcgctcactttaattatattcctcatgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaatga

SEQ ID NO: 11033 - RNA, 5073 nt, synthetic construct
  misc_feature 1..5073: note = Cas13a variant__Leptotrichia wadei__WP_021746774.1__XY_Cas13a(R474A,R1046A)_EGFP_ZF-CCR5 T_KRAB -A _NLS
  source 1..5073: mol_type = other RNA
atgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggtaccgcgggcccgggcgccaccatgaaagtgaccaaggtcgacggcatcagccacaagaagtacatcgaagagggcaagctcgtgaagtccaccagcgaggaaaaccggaccagcgagagactgagcgagctgctgagcatccggctggacatctacatcaagaaccccgacaacgcctccgaggaagagaaccggatcagaagagagaacctgaagaagttctttagcaacaaggtgctgcacctgaaggacagcgtgctgtatctgaagaaccggaaagaaaagaacgccgtgcaggacaagaactatagcgaagaggacatcagcgagtacgacctgaaaaacaagaacagcttctccgtgctgaagaagatcctgctgaacgaggacgtgaactctgaggaactggaaatctttcggaaggacgtggaagccaagctgaacaagatcaacagcctgaagtacagcttcgaagagaacaaggccaactaccagaagatcaacgagaacaacgtggaaaaagtgggcggcaagagcaagcggaacatcatctacgactactacagagagagcgccaagcgcaacgactacatcaacaacgtgcaggaagccttcgacaagctgtataagaaagaggatatcgagaaactgtttttcctgatcgagaacagcaagaagcacgagaagtacaagatccgcgagtactatcacaagatcatcggccggaagaacgacaaagagaacttcgccaagattatctacgaagagatccagaacgtgaacaacatcaaagagctgattgagaagatccccgacatgtctgagctgaagaaaagccaggtgttctacaagtactacctggacaaagaggaactgaacgacaagaatattaagtacgccttctgccacttcgtggaaatcgagatgtcccagctgctgaaaaactacgtgtacaagcggctgagcaacatcagcaacgataagatcaagcggatcttcgagtaccagaatctgaaaaagctgatcgaaaacaaactgctgaacaagctggacacctacgtgcggaactgcggcaagtacaactactatctgcaagtgggcgagatcgccacctccgactttatcgcccggaaccggcagaacgaggccttcctgagaaacatcatcggcgtgtccagcgtggcctacttcagcctgaggaacatcctggaaaccgagaacgagaacggtatcaccggccggatgcggggcaagaccgtgaagaacaacaagggcgaagagaaatacgtgtccggcgaggtggacaagatctacaatgagaacaagcagaacgaagtgaaagaaaatctgaagatgttctacagctacgacttcaacatggacaacaagaacgagatcgaggacttcttcgccaatatcgatgaggccatctctagtattgctcacggcatcgtgcatttcaacctggaactggaaggcaaggacatcttcgccttcaagaatatcgcccccagcgagatctccaagaagatgtttcagaacgaaatcaacgaaaagaagctgaagctgaaaatcttcaagcagctgaacagcgccaacgtgttcaactactacgagaaggatgtgatcatcaagtacctgaagaataccaagttcaacttcgtgaacaaaaacatccccttcgtgcccagcttcaccaagctgtacaacaagattgaggacctgcggaataccctgaagtttttttggagcgtgcccaaggacaaagaagagaaggacgcccagatctacctgctgaagaatatctactacggcgagttcctgaacaagttcgtgaaaaactccaaggtgttctttaagatcaccaatgaagtgatcaagattaacaagcagcggaaccagaaaaccggccactacaagtatcagaagttcgagaacatcgagaaaaccgtgcccgtggaatacctggccatcatccagagcagagagatgatcaacaaccaggacaaagaggaaaagaatacctacatcgactttattcagcagattttcctgaagggcttcatcgactacctgaacaagaacaatctgaagtatatcgagagcaacaacaacaatgacaacaacgacatcttctccaagatcaagatcaaaaaggataacaaagagaagtacgacaagatcctgaagaactatgagaagcacaatcggaacaaagaaatccctcacgagatcaatgagttcgtgcgcgagatcaagctggggaagattctgaagtacaccgagaatctgaacatgttttacctgatcctgaagctgctgaaccacaaagagctgaccaacctgaagggcagcctggaaaagtaccagtccgccaacaaagaagaaaccttcagcgacgagttggaactgatcaacctgctgaacctggacaacaacagagtgaccgaggacttcgagctggaagccaacgagatcggcaagttcctggacttcaacgaaaacaaaatcaaggaccggaaagagctgaaaaagttcgacaccaacaagatctatttcgacggcgagaacatcatcaagcaccgggccttctacaatatcaagaaatacggcatgctgaatctgctggaaaagatcgccgataaggccaagtataagatcagcctgaaagaactgaaagagtacagcaacaagaagaatgagattgaaaagaactacaccatgcagcagaacctgcaccggaagtacgccagacccaagaaggacgaaaagttcaacgacgaggactacaaagagtatgagaaggccatcggcaacatccagaagtacacccacctgaagaacaaggtggaattcaatgagctgaacctgctgcagggcctgctgctgaagatcctgcaccggctcgtgggctacaccagcatctgggagcgggacctgagattccggctgaagggcgagtttcccgagaaccactacatcgaggaaattttcaatttcgacaactccaagaatgtgaagtacaaaagcggccagatcgtggaaaagtatatcaacttctacaaagaactgtacaaggacaatgtggaaaagcggagcatctactccgacaagaaagtgaagaaactgaagcaggagaagaaagacctgtatattgcaaactacatcgctcactttaattatattcctcatgccgagattagcctgctggaagtgctggaaaacctgcggaagctgctgtcctacgaccggaagctgaagaacgccatcatgaagtccatcgtggacattctgaaagaatacggcttcgtggccaccttcaagatcggcgctgacaagaagatcgaaatccagaccctggaatcagagaagatcgtgcacctgaagaatctgaagaaaaagaaactgatgaccgaccggaacagcgaggaactgtgcgaactcgtgaaagtcatgttcgagtacaaggccctggaaggaggaggtggaagcggaggaggaggaagcggaggaggaggtagcgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtactctaggggagctggcgctggagcgggtgcaggggctggctctagattccagtgccggatctgcatgcggaacttcagcgaccggtccaacctgagcaggcacatcagaacccacaccggagaaaagcccttcgcctgcgacatttgcggccggaagttcgccatcagcagcaacctgaacagccacaccaagatccacactggcagccagaaacctttccagtgcagaatttgtatgagaaactttagcagaagcgacaacctggccagacacatccggacacatactggtgaaaaaccttttgcctgtgatatctgtggcagaaagtttgccacctccggcaatctgacccggcacacaaagattcacctgcggggcagccagctatcgattgtcgacgctcctgaacaacgtgaaggtgcttctcaagtttctgtttctgttacttttgaagatgttgctgttctttttactcgtgatgaatggaaaaaacttgatctttctcaacgttctctttatcgtgaagttatgcttgaaaattattctaatcttgcttctatggctggatcccccaagaaaaagcgcaaggtataa

SEQ ID NO: 11034 - RNA, 3549 nt, synthetic construct
  misc_feature 1..3549: note = Cas13a variant__Leptotrichia wadei__ERK53440.1__Cas13a
  source 1..3549: mol_type = other RNA
atgtatatgaagattacaaagattgatggagtatcacattataaaaaacaagacaagggcatcttgaaaaagaagtggaaggacctggacgaacgcaagcagcgcgagaaaatcgaggcgcgctataacaaacagatcgagtcgaaaatttacaaggaattctttcgcctgaagaacaagaagcgtatcgagaaagaggaagatcagaatattaaaagcttatactttttcattaaggagttgtacttgaatgaaaagaatgaagaatgggagctgaagaatattaatctggagatcttagatgacaaggaacgtgttattaaggggtacaaattcaaagaggatgtgtatttttttaaagaaggctataaggagtattatctgcgcattctgttcaacaacttgattgagaaagtacaaaatgagaatcgtgaaaaggtacgcaagaacaaagagttcttggatctgaaagagattttcaagaaatacaaaaaccgcaagattgatctgttactgaagtcaatcaacaataacaagattaacctggagtataaaaaagaaaatgtcaatgaggagatctatggaattaacccgaccaacgaccgcgaaatgactttttatgaattgctgaaggagattattgaaaagaaggatgaacagaaatcgatcttggaggagaaattagacaattttgatattacgaacttccttgaaaatatcgaaaaaatcttcaatgaggaaacggagatcaatatcatcaaaggtaaggtattgaatgagcttcgtgaatatatcaaagaaaaggaagaaaacaactccgacaacaagttaaagcagatctacaacttggagcttaaaaagtatatcgagaacaacttctcctacaaaaagcaaaagagtaaatcgaagaacggcaagaatgactacctgtacctgaacttcctcaagaagattatgttcatcgaagaagtggatgagaagaaagagatcaacaaggaaaaattcaaaaacaagatcaacagtaactttaagaacctgtttgtccagcacattttggactatgggaaactgctgtattataaggagaacgacgaatacatcaagaacacagggcaacttgaaacaaaggatttggagtatattaaaactaaggaaactcttatccgcaagatggcggtgttagtctcttttgcagcgaacagctattacaacctgtttgggcgcgtttctggggacattttggggaccgaagtagtaaaatcttctaagacgaacgtcatcaaggttggatcacacattttcaaggaaaagatgttgaattacttctttgatttcgaaatcttcgatgctaacaagatcgtcgagatcttggaatctatttcatactccatctataatgtacgcaatggagtcgggcatttcaataagttaattttgggcaaatataagaagaaagacattaatactaataagcgcatcgaagaagacctgaacaacaatgaagaaatcaagggttacttcatcaagaaacgtggcgagatcgaacgcaaagttaaggagaagtttttgtccaataacctgcaatattactatagcaaagaaaagattgagaattatttcgaggtgtacgaattcgagattctgaaacgcaagatcccctttgctccgaacttcaaacgtattatcaaaaaaggggaggacttgttcaataacaaaaacaacaagaagtacgaatacttcaagaatttcgataagaattcggcggaagaaaagaaggagtttctgaaaactcgcaattttttacttaaagagctttactacaataacttttacaaagagttcctgagtaagaaagaagaattcgagaagattgtattggaagtaaaggaggagaaaaagtctcgcggcaatattaacaacaagaaatccggggtatctttccagagcatcgatgattatgacactaagattaacatcagcgattatatcgcatcgattcacaaaaaagaaatggagcgtgtagagaagtacaatgaagaaaagcagaaggataccgcaaagtacattcgtgactttgtcgaagagatcttcctgactggtttcatcaattacttggagaaagataaacgcctgcacttcttaaaagaagaattctctatcttgtgtaataataacaacaacgtcgtggacttcaacatcaacattaacgaagagaagattaaagagttccttaaagaaaatgatagcaagacgctgaacctttacttattcttcaatatgattgactcgaagcgtatctctgagtttcgcaatgagcttgttaagtacaagcaatttacgaagaagcgtttagatgaggagaaagaattcttaggtattaagatcgaattatacgagaccttaattgaattcgtgatcctgacccgcgagaaactggacacgaaaaaatccgaggaaattgacgcatggctggtagataagctgtatgtgaaggactctaatgagtataaggagtatgaggaaatccttaaattgtttgtagacgaaaaaattttgtcctctaaagaggctccctattacgctaccgacaacaaaactcctattttactgagtaacttcgagaaaacacgtaaatacggaacgcaatccttcttgtccgagatccagagcaattacaagtattccaaagtggagaaggagaatatcgaagattacaacaagaaagaggaaatcgagcagaagaaaaagtcgaatatcgaaaagttacaagatttaaaggtcgaacttcacaagaaatgggagcaaaataagatcaccgaaaaggagattgaaaagtacaataataccacgcgtaaaatcaatgaatacaactacttgaagaataaggaagagttgcagaacgtatatttgttacatgagatgttaagcgatttacttgcacgcaatgtggctttcttcaacaagtgggagcgtgattttaagttcattgttattgctatcaaacaattcttacgtgagaatgacaaagaaaaagtcaacgaatttcttaatcctccggacaactccaagggcaaaaaagtttacttttcagtaagcaagtataaaaacacagtcgaaaacattgacggaattcacaagaacttcatgaacctgatctttctgaacaacaagttcatgaaccgcaagattgacaaaatgaactgtgcaatctgggtttatttccgtaattatattgcacattttttacacctgcatacaaagaacgaaaaaatctccttaatcagccagatgaatcttctgatcaaattatttagctacgacaaaaaagtccaaaaccatattttaaagtctaccaagacgttattggagaaatacaacatccagatcaacttcgagatctccaacgacaaaaatgaagttttcaagtataagatcaaaaatcgcttgtatagtaagaagggcaagatgttggggaagaacaataaattcgagatcttagagaatgagttcttggagaacgtgaaggcaatgctggaatatagtgaataa

SEQ ID NO: 11035 - RNA, 4158 nt, synthetic construct
  misc_feature 1..4158: note = Cas13a variant__Clostridium aminophilum__WP_031473346.1__Cas13a
  source 1..4158: mol_type = other RNA
atgaagttcagtaaagtcgatcatacacgtagtgctgttggtattcaaaaggccacagatagcgttcacgggatgctgtatactgaccccaaaaaacaggaagtcaatgatcttgataaacgcttcgaccaattaaacgtaaaggcgaaacgcttgtataacgtgttcaatcaatccaaagcggaggaggacgatgacgagaaacgtttcggaaaggtggtaaaaaaattaaatcgcgaactgaaggatctgctttttcaccgtgaagtgtctcgttataactccattgggaacgccaagtacaattactatgggattaaatctaacccagaagaaattgtctccaacctgggaatggtggagagtcttaagggcgagcgtgatccccaaaaggttatctcaaaattactgctttattaccttcgtaagggacttaagccgggaaccgacggcctgcgtatgattctggaggcttcatgtggtttacgtaaactttccggtgacgaaaaggaattaaaggtttttcttcaaaccctggatgaggatttcgaaaagaagacgtttaaaaaaaacctgattcgctcgatcgaaaatcaaaatatggccgttcagccttccaatgagggtgatcctatcatcggcattacccagggacgttttaactcgcagaagaacgaagagaaaagcgccatcgaacgcatgatgtcaatgtatgctgacctgaatgaggatcaccgtgaagatgtattacgcaaactgcgtcgccttaatgtcctgtattttaacgttgacaccgaaaaaacagaggagccgacacttccaggcgaggtggatacaaatcccgtttttgaggtgtggcatgaccacgaaaaaggcaaagaaaatgaccgccagtttgctacctttgcaaaaattttaactgaagaccgtgagacacgtaaaaaggagaagttggctgtcaaagaggcgttgaacgatttgaaatccgccattcgcgaccataatattatggcctaccgttgctctattaaggttactgaacaggacaaagacgggctgttcttcgaggatcaacgtatcaatcgcttttggatccaccacatcgagagcgcagtcgagcgcatcttagcatcgattaatcccgaaaaattgtataaactgcgcattgggtatcttggagagaaggtatggaaggatcttttgaactatctttctattaaatacatcgccgtgggcaaggcagtgtttcacttcgctatggaggatttgggaaaaactgggcaagacatcgaattgggcaaactgtcaaacagtgtaagcggcggcttaacatccttcgattacgagcagattcgcgctgacgaaacgcttcaacgtcagttaagcgttgaagttgcctttgcagcaaataacctgttccgtgccgttgtaggacagaccggcaagaagattgagcaatccaaatctgaggagaatgaggaggacttccttttatggaaagctgaaaaaattgcggaatcaattaaaaaagaaggtgagggaaacacgcttaaaagtatcttgcaattcttcgggggagcgagctcctgggatttgaaccatttttgcgcagcgtatggtaacgagtcgtctgcattagggtatgaaactaaattcgcagacgacctgcgcaaggcgatttactcactgcgtaatgagacctttcattttactacacttaacaaaggatcatttgactggaatgcaaagttaatcggtgacatgtttagccacgaggctgcaacggggatcgcagtagaacgcacgcgcttttactcgaacaatttaccgatgttttaccgcgagtcggacttgaaacgcatcatggaccatttatacaatacctaccacccccgtgcgtcccaagttcctagttttaactcagttttcgtgcgcaagaatttccgcctgtttctgagtaatacgctgaacaccaatacctcattcgacactgaagtataccaaaagtgggagagcggtgtctattatctgttcaaggagatctattataacagtttcttaccaagtggtgacgcccaccatcttttctttgaagggttacgtcgcatccgtaaagaagctgacaatctgccgatcgtgggtaaagaagctaagaaacgcaatgcggttcaagattttggtcgtcgttgtgacgaacttaagaatctttctctgagcgccatttgccagatgattatgaccgaatataatgagcaaaataatggaaatcgtaaggtcaagtctacacgtgaagataaacgtaagccagatattttccagcactataaaatgctgttactgcgcaccttgcaggaggcttttgcgatctatattcgtcgcgaagagttcaagtttatcttcgacttgccaaaaaccctttatgtgatgaaaccagtcgaagagttcttgcctaattggaaatccgggatgttcgatagtttagtggaacgcgtaaagcagtcgcccgacttacagcgctggtacgtgttgtgtaaatttttaaatgggcgtttgttgaatcaattatcaggggtaattcgctcatatatccagtttgcaggagatatccaacgccgcgcaaaagctaatcataaccgcttgtatatggataacacgcagcgcgttgagtattattcaaacgtcttagaagtggtggatttctgtattaagggcacttctcgcttctccaacgtgttctctgattatttccgcgacgaagatgcatatgccgattaccttgacaattacttgcaatttaaagatgagaaaatcgcggaggtctccagttttgcagccttgaagacattttgtaacgaagaggaggttaaagcaggaatttacatggatggagaaaaccccgttatgcagcgcaatatcgttatggccaaacttttcgggccggatgaggttctgaaaaatgtggttccgaaggttacgcgtgaggagatcgaggaatattaccagttagagaaacagattgctccatatcgccagaatggatattgtaaatccgaggaggaccaaaagaaacttcttcgctttcagcgtatcaaaaatcgtgttgaattccagacgatcaccgagttcagcgagattattaatgagctgttaggacagctgatttcctggagcttcttacgtgaacgcgacttgctgtactttcagctgggctttcactacctttgtcttcacaatgacacggagaagcctgccgaatacaaggaaatttctcgcgaggacggcacagttatccgtaatgccattttgcatcaggtggctgctatgtatgtgggtggattgcccgtttacaccttagccgacaagaagttggccgcattcgagaagggcgaggcggattgcaaactgagcatttcgaaagatacagcaggggccggtaagaagattaaggattttttccgctacagtaaatacgtattgattaaagatcgtatgctgaccgaccagaatcagaaatacacaatctacttagcgggtctggagttgttcgagaacacggatgaacatgacaatattacggacgtacgcaagtacgtagatcattttaagtattatgctacgagtgatgaaaacgccatgtctattcttgatctgtacagtgagattcatgatcgtttcttcacgtatgacatgaagtatcaaaagaacgtagccaacatgcttgagaatatccttttacgtcacttcgtgcttatccgtcctgagtttttcactggtagtaagaaagtcggggaaggaaaaaagattacatgtaaggctcgtgcacaaattgagattgcagaaaacgggatgcgttcagaggactttacgtataaactgtccgatgggaaaaagaacattagcacctgtatgattgcggcacgcgaccagaagtatctgaatacggtcgcgcgtttactgtactatccacacgaggcaaagaagtcgatcgtcgacacgcgcgaaaagaaaaacaataagaagacaaaccgcggtgacggcaccttcaataagcagaaaggtactgcacgtaaggaaaaggataatgggccccgcgaattcaacgatacgggctttagcaatacgccatttgcaggtttcgacccctttcgtaatagctaa

SEQ ID NO: 11036 - RNA, 4035 nt, synthetic construct
  misc_feature 1..4035: note = Cas13a variant__Eubacterium rectale__CVRQ01000008.1__Cas13a
  source 1..4035: mol_type = other RNA
atgctgcgtcgtgataaggaagtgaaaaagctttataacgtttttaatcagatccaggtcggtacgaagcctaaaaaatggaataatgatgaaaaattgtcgcccgaagagaatgaacgtcgcgctcaacagaaaaatatcaagatgaaaaactacaaatggcgtgaagcctgctcaaagtatgttgagtcctcgcaacgcattatcaacgatgttattttttactcttatcgtaaagcgaaaaataagttacgctacatgcgcaagaatgaggatatcttgaagaagatgcaagaggcagagaagttgtccaagttcagtggcggcaagttggaggattttgtcgcatacaccttgcgtaagtcgttagtagtctccaagtacgatacacaagagttcgatagtttagctgctatggttgtattccttgagtgtattggtaaaaataacatctccgatcatgagcgcgagatcgtttgtaaactgcttgaattaattcgtaaggactttagtaagttggatccaaatgttaaggggtcacaaggtgcaaacattgtccgcagtgtccgcaatcagaatatgattgtacaaccccagggggatcgtttccttttcccccaggtgtatgcgaaggagaatgagaccgtcactaataaaaatgtagaaaaagaaggtttaaacgagttccttctgaattacgcgaatcttgacgacgagaaacgcgcggaaagtttgcgcaaattgcgccgtattcttgacgtttacttttctgcaccaaaccactatgaaaaggacatggatatcacattaagcgacaacattgaaaaggagaagttcaacgtgtgggagaaacacgaatgtggcaaaaaggagacaggcttatttgtggacatcccagatgtattaatggaagcagaagcagagaacattaaattagacgccgtggtagagaaacgtgagcgtaaagtcttaaacgatcgtgtacgtaaacaaaacatcatctgctaccgctatacgcgcgcagtggtggagaaatacaattccaacgagcctttgttctttgagaataatgccatcaaccaatactggatccaccatattgaaaacgccgtcgaacgtattcttaaaaactgtaaagcaggtaagttgttcaagctgcgcaaggggtatcttgcagagaaagtctggaaagatgccatcaacttaatctccatcaaatacattgcgttagggaaggccgtatacaattttgcgttagacgacatctggaaggacaagaaaaataaggaactggggatcgtggatgagcgcatccgtaacggcatcactagttttgattatgaaatgatcaaggcgcacgagaacttgcaacgtgaacttgctgtggacattgcgttttcggtgaacaaccttgcacgcgctgtttgtgacatgagtaacttgggtaataaagaatcggatttcctgttgtggaaacgcaacgacattgccgacaagttaaagaacaaggatgacatggctagcgttagcgctgtactgcagtttttcggtggcaagtccagctgggatatcaacatttttaaagatgcctataaaggtaaaaagaaatacaattacgaagttcgttttatcgacgatctgcgcaaggcgatctattgtgcacgcaacgagaatttccatttcaagacagcgttggttaacgatgaaaagtggaatactgaattgtttggcaaaatcttcgaacgcgagacggagttttgccttaatgtggagaaagaccgcttctactcgaacaacttatacatgttctaccaggtaagtgaactgcgcaacatgcttgatcacctgtatagtcgctcagtaagtcgcgccgcccaagtgccttcttacaattctgtaattgttcgcactgctttccccgagtatatcacgaatgtattaggatatcagaaaccaagctacgatgctgacacgttagggaagtggtacagcgcctgctactatttgttgaaagaaatctattacaattccttcttacagtcggatcgtgcgttgcagctttttgagaaatcagttaaaaccctgtcatgggacgataaaaaacaacaacgtgcggtagataattttaaggatcacttttccgacattaaatcagcctgcactagtttagcccaggtgtgtcagatttatatgacggagtacaaccagcagaacaaccaaattaaaaaggttcgctcatcaaatgactctattttcgatcaaccagtctaccaacattacaaggtcttattgaagaaggcgattgcaaacgcttttgcggactatttgaagaataacaaggacttattcggttttatcggcaaaccgttcaaggctaatgaaatccgtgagattgacaaagaacagtttctgcccgactggactagtcgcaaatacgaagcattatgtatcgaggttagcggaagccaagaattgcagaaatggtacatcgtaggtaaattcttgaacgcccgtagtttaaacttgatggtgggttccatgcgctcctatatccaatacgtcacagatattaaacgccgtgcagcatctattggtaatgaattgcatgtatcggtacatgatgtagaaaaggtagagaagtgggtgcaggtcatcgaggtttgttccttactggcctcgcgtactagtaatcagttcgaagactactttaacgataaggatgactacgcacgttacttaaagtcatacgtcgatttttcaaacgttgacatgccctccgagtactcagccttagtggattttagcaatgaggagcaatctgatttgtatgtggacccaaagaaccctaaggtaaatcgcaacatcgtgcactcgaaactgtttgcagcagatcatattttacgcgacatcgtcgagccagtcagcaaggataatattgaagaattttactcacagaaggcggagattgcttattgtaaaatcaaggggaaagagatcacggcggaggagcaaaaagccgtgttgaaatatcaaaaactgaaaaaccgtgtggaactgcgtgatatcgtagagtatggcgaaattatcaacgagttgttgggacagctgattaattggagcttcatgcgtgaacgtgacttgttatacttccaacttggatttcattacgactgtttacgcaacgatagtaagaaacctgaaggttataagaatattaaagtggacgagaattctatcaaggacgctatcttataccagatcattggaatgtatgtcaatggggtaactgtatacgcgcctgaaaaagatggggataaattgaaggaacagtgtgtgaaaggaggagtgggagtgaaagtaagtgcgttccaccgctattctaaatatttaggactgaatgaaaaaacgctttacaacgccggtctggagattttcgaagtcgtagcggagcatgaggacattatcaacttacgcaacggcatcgatcactttaagtactatttgggcgattatcgttctatgttgtcgatttacagcgaagtcttcgatcgctttttcacttatgacattaaataccagaaaaatgtattgaatttactgcaaaatatccttttgcgccacaatgtcatcgtcgagccgattttggagtcgggtttcaagaccattggggagcagactaaaccaggtgcaaagttgtcgattcgcagtattaaaagtgacacattccaatacaaggttaaaggcgggacattgattacagacgctaaggacgagcgttaccttgaaacgattcgtaagattctgtactacgctgaaaatgaagaggataacctgaaaaagtcagtggtcgttacaaacgctgacaaatacgagaaaaataaggagtcagacgaccagaataaacagaaagagaaaaagaataaggacaataaggggaaaaagaacgaggagacaaaatctgacgccgagaaaaacaataacgaacgcttatcatacaacccctttgcgaatcttaactttaagctgagcaactaa

SEQ ID NO: 11037 - RNA, 3858 nt, synthetic construct
  misc_feature 1..3858: note = Cas13a variant__Herbinix hemicellulosilytica__CRZ35554.1__Cas13a
  source 1..3858: mol_type = other RNA
atgaagttgacgcgtcgccgcatcagtggcaattcagtcgaccagaagattacagctgcgttttatcgtgatatgtcgcaagggttattatattatgattcggaggacaatgactgtacggacaaggtcatcgaaagtatggatttcgaacgctcttggcgtggacgcattctgaagaacggcgaggatgataagaatccgttttacatgttcgttaaaggtttagttggttccaacgataagatcgtgtgcgaacctatcgacgtcgactcagaccctgataacttagatatcttgattaacaaaaatctgacggggttcggacgcaacttgaaagcacctgacagtaacgataccttagaaaatcttatccgcaaaatccaggccggcattcccgaagaagaggttcttccggagctgaagaaaattaaagagatgatccagaaagacatcgttaaccgcaaagagcagttgcttaaatccatcaaaaacaaccgtattcctttttcattggaaggttccaagctggtcccttccaccaaaaagatgaagtggcttttcaagttgattgacgttcctaataaaaccttcaatgaaaaaatgttggagaagtactgggagatctacgactatgacaagcttaaggcgaatatcacgaaccgcctggacaaaacggataagaaggcacgttcaatttcgcgtgcggtaagcgaggagttacgtgagtaccataaaaacttgcgcacaaactataatcgcttcgtatctggagaccgtccagcagccgggcttgacaatggggggagtgctaaatataatcccgataaggaggagttcttattgtttcttaaagaagttgagcagtacttcaagaaatacttcccagtcaagagcaagcattcgaacaagtccaaagacaaatcattggttgataagtacaaaaattattgcagttacaaagtggtcaagaaagaggtcaaccgcagcatcatcaatcaattggtggctggacttattcagcagggtaagcttctgtattacttctactataacgatacctggcaggaggatttcctgaattcctacggtcttagttatattcaggttgaggaggcatttaaaaagagtgtaatgaccagtctttcgtggggaatcaaccgtctgacctcgttctttatcgacgactcgaacactgtgaagtttgatgatatcacaacgaaaaaggctaaggaggcgattgagtctaattatttcaacaaattacgcacatgctcccgtatgcaggaccacttcaaagagaaattggccttcttttacccggtgtatgtgaaggacaagaaggatcgcccggatgatgatatcgaaaacttaattgtactggttaagaacgccattgagagcgtgagctatttgcgcaatcgcacgtttcactttaaagagagctccttattggagctgcttaaagagttagacgataaaaattctggtcaaaataaaatcgactatagcgtagccgctgaatttattaaacgcgatatcgagaacttgtatgacgtcttccgtgaacagatccgctcacttggtattgctgagtactacaaggcggacatgatttcggactgttttaagacatgcgggttagaattcgcgctttattcgccaaaaaattcgttgatgcccgcttttaagaacgtttataaacgcggagcaaatcttaacaaggcgtatattcgcgataaagggccaaaggaaacaggagaccagggtcagaactcgtacaaagctttggaggaatatcgtgagcttacatggtatattgaggtgaagaataacgaccagtcgtacaacgcctacaagaatttgcttcaactgatttattatcatgcgtttcttccggaggttcgtgaaaatgaggctcttatcactgacttcattaaccgcactaaagagtggaatcgtaaggaaacagaggagcgtctgaacactaaaaacaataaaaaacacaagaatttcgacgagaatgacgatattacggtaaatacgtatcgttacgaatctattccggattaccagggggaatcccttgatgattatcttaaggtgttacagcgcaagcaaatggcgcgtgcgaaggaggtaaatgagaaggaggagggcaacaataactatatccaattcattcgtgacgtcgtagtatgggcgttcggggcctacttggaaaacaagctgaagaattataagaacgaactgcaaccaccgttgagcaaagagaacattggcttaaatgataccttaaaggaattgtttcccgaagaaaaagtaaagtcaccatttaatatcaagtgccgtttctccattagtacatttatcgacaacaaaggtaagtccaccgataatacctcggccgaggccgtcaagactgatggcaaggaggacgaaaaggacaaaaagaatattaaacgcaaagacttgctttgcttttacctgttcttacgcttgcttgatgaaaacgaaatttgcaaattacaacaccaatttattaaataccgttgcagtttaaaagagcgtcgttttccaggtaaccgcaccaaactggagaaggaaactgaacttttggccgagctggaagaactgatggaactggtacgttttacgatgccatcaattcctgaaatctctgcaaaggcggaatcaggttatgacacaatgattaagaagtattttaaagacttcatcgagaaaaaagtctttaagaatccgaagacgtccaacctgtactaccactccgactctaaaactccggtcacccgcaaatatatggctctgctgatgcgttctgcgcctttgcatctctacaaggatatcttcaagggctactatttgatcactaagaaggagtgtttggagtatattaaattaagcaacatcattaaagactatcaaaactcattgaatgaattgcacgagcagctggagcgcattaaattaaagagtgagaaacaaaacgggaaagactctctgtatcttgacaaaaaggacttctataaagtaaaggagtacgtcgaaaatttagaacaagtggcgcgttacaagcacttgcagcacaaaatcaacttcgaaagcttataccgtatttttcgtattcacgtggacatcgctgcgcgtatggtcggttatacccaagactgggagcgtgatatgcactttcttttcaaggcgttggtctataatggcgtacttgaggagcgccgttttgaagcaatctttaacaataacgatgacaacaacgacgggcgtatcgtaaaaaagatccagaataacttaaataacaagaaccgcgaattagtatctatgttatgttggaataaaaagctgaacaagaacgaatttggtgctattatttggaagcgtaaccctatcgcccatctgaaccactttacacaaacggaacaaaactcaaagtcgagccttgaatctctgatcaactcgctgcgcatcctgttagcgtacgaccgtaaacgtcaaaacgctgtgacaaagactatcaatgaccttctgttaaacgactatcacatccgcattaagtgggaagggcgcgtggatgaagggcagatctactttaatatcaaggaaaaggaagacatcgagaacgagcctattatccacttgaaacacctgcataaaaaggactgctacatttacaagaacagctatatgttcgacaagcaaaaggagtggatttgtaatggcattaaagaagaagtttatgacaagtccattcttaagtgtatcggaaacttgttcaagtttgactatgaggacaaaaacaaatcctcagcaaatcctaagcacacctaa

SEQ ID NO: 11038 - RNA, 4314 nt, synthetic construct
  misc_feature 1..4314: note = Cas13a variant__Lachnospiraceae bacterium__WP_022785443.1__Cas13a
  source 1..4314: mol_type = other RNA
atgaagatcagtaaagtacgcgaagaaaaccgtggggccaaattgactgtgaacgccaagactgctgtagtgtccgagaaccgttcgcaagaagggatcctgtataatgacccaagtcgttacggtaaaagccgcaaaaatgacgaggatcgtgaccgctacatcgagtcccgtcttaagtcttctgggaaattataccgcatttttaatgaggacaagaacaaacgcgagacagacgaactgcaatggttccttagtgagatcgtgaagaagatcaatcgtcgcaatggtttggtattatcggatatgcttagtgtggacgaccgcgcattcgagaaagccttcgaaaagtatgcagagttatcgtatacgaatcgccgtaataaagtttctggtagcccggcgttcgagacctgcggagtagatgcagcaacagctgaacgtttaaaaggcattatctcggaaaccaactttatcaaccgtatcaaaaacaatatcgacaacaaagtctcggaggacattatcgatcgtattatcgctaagtacttgaagaaaagcttgtgtcgtgagcgtgtcaaacgtgggttaaagaaacttttaatgaatgccttcgacttgccttacagtgaccctgacatcgatgtgcaacgcgattttattgattacgttttagaggatttctaccatgttcgtgccaagtcacaagtgtctcgttcgatcaaaaacatgaatatgccggtgcagcccgaaggcgatggtaagtttgcgatcacagtaagtaagggtgggacggaatcggggaacaaacgctctgccgaaaaagaagcattcaaaaagttcctgagtgattacgcgtcgctggatgaacgtgttcgtgacgacatgcttcgtcgcatgcgccgcctggtcgtcttgtacttttacggatcagacgatagcaaattatcagatgttaacgaaaaattcgacgtatgggaggaccatgctgcccgccgcgtagacaatcgcgagttcatcaagcttccgttggagaataaacttgccaacggcaagaccgataaagatgcggaacgtatccgtaagaacaccgttaaagaactgtatcgtaaccaaaatattggatgctatcgccaggctgttaaagccgtagaggaggacaacaacggtcgctacttcgacgacaagatgctgaacatgttctttattcaccgcatcgagtacggtgtggaaaagatttacgccaatttgaaacaagtcacggagttcaaggcccgcactgggtatctttcagagaaaatctggaaagacttgatcaattacatttccattaaatacatcgctatgggcaaggcagtctacaattacgccatggatgagctgaatgcctcagacaaaaaggagatcgagctgggcaagatcagtgaagaatatttgtccgggatcagttcgtttgactatgaattgatcaaagccgaagagatgctgcaacgcgagaccgctgtatatgttgctttcgcggctcgccacttgtcctcccagaccgttgaactggattccgagaactccgacttccttcttttgaagccaaagggaactatggacaagaacgataaaaacaagttagcctccaacaacattcttaattttcttaaggacaaggaaacacttcgcgataccattttacagtactttggcggccacagtctgtggaccgactttccgtttgacaaatacttggccggcgggaaagacgacgtcgacttcctgacagaccttaaagatgtgatttactccatgcgtaatgatagttttcactatgctactgaaaaccacaacaatggaaaatggaataaggaattaattagtgcaatgtttgaacatgaaacagagcgtatgacagtagtcatgaaagataaattctactcgaataatcttcctatgttctataagaatgacgacttgaagaaattgctgatcgatttgtacaaggataacgtagagcgtgcgagccaggtcccatcttttaacaaggtcttcgtgcgcaagaattttcctgctttggttcgcgataaagacaacttggggattgaattagaccttaaggcggacgcggataaaggtgagaacgagttaaaattctacaacgctctttattacatgtttaaagagatctactataacgcgttcttaaatgataagaatgtgcgtgaacgttttattactaaggcgacgaaagtggccgataactatgatcgcaataaggagcgcaaccttaaagaccgtattaagtccgcggggtcggatgagaaaaaaaagttacgtgaacagctgcagaattacattgctgagaatgacttcgggcagcgtatcaagaatatcgtgcaggtcaatccggattataccctggctcaaatctgccaacttattatgacggagtataatcaacaaaacaacgggtgcatgcagaaaaagtctgctgcccgcaaagacatcaataaggatagttaccagcattacaagatgctgcttttggttaatttacgcaaagcatttttggaatttattaaggagaattatgcttttgttttgaaaccctataaacacgacctttgtgataaagccgatttcgtgccagatttcgccaaatacgtcaaaccctacgctggcttgatcagccgtgtagcaggatcaagtgagctgcaaaagtggtacatcgtgagccgcttcttgtctccggcacaggccaatcacatgcttgggttcctgcactcgtacaagcagtacgtatgggatatttaccgccgcgcatccgaaaccggtacagagattaaccactctatcgcagaggacaagattgctggggttgacattaccgacgtcgacgcagtgatcgatttatcggtgaaattgtgcggaacaatctctagcgagatttcggattatttcaaggatgacgaggtctacgcggagtacatctcatcatatttagatttcgaatacgatggtggtaattacaaagactcgctgaaccgtttctgtaattcagacgcagtaaatgaccaaaaagtggcactgtattatgacggcgaacacccgaaattgaatcgtaacattatcttgtcgaaactttacggagagcgccgtttcttggagaaaatcactgaccgcgtttctcgttcagatattgtggagtattacaagctgaagaaggagacgtcgcagtatcagacgaaagggattttcgatagtgaggacgaacagaagaatattaagaagtttcaggagatgaaaaacatcgtggaatttcgtgatctgatggattactcggagatcgcggacgaattacaaggacaactgatcaactggatttatcttcgtgaacgtgacctgatgaacttccaactggggtatcattacgcctgcttgaacaacgactcaaataagcaagctacttatgtaactcttgattaccaaggtaaaaaaaaccgcaagattaacggtgcgattttatatcagatttgtgcaatgtatattaatggactgccgctttactacgtcgataaagacagttcggagtggacggtgagcgacggtaaggaatccacgggagccaagattggtgaattctaccgctatgcaaagtcctttgaaaatacgtctgactgctacgcttcgggcttagagatcttcgagaatatcagtgagcacgacaacatcacggaattacgcaactacattgaacattttcgttactacagctcttttgaccgttcctttttggggatctattcagaggtgtttgatcgctttttcacatacgacttaaagtatcgcaaaaacgtacctaccatcttgtataatattttactgcaacactttgttaatgtccgcttcgagttcgtaagcggcaaaaaaatgattggcattgacaaaaaggaccgcaagattgccaaagagaaggaatgcgctcgtattacaatccgcgaaaagaacggtgtctactcggagcagttcacttacaagttgaagaatgggaccgtgtatgtcgatgcgcgtgacaaacgctacctgcagtccattattcgtcttttgttttaccccgaaaaggtcaacatggacgaaatgatcgaagttaaggaaaagaagaagccgagtgacaataatacgggaaagggctatagcaaacgcgaccgccagcaggatcgtaaagaatatgacaagtacaaagaaaaaaagaaaaaggaggggaatttcctttcaggtatgggaggcaatatcaactgggacgagattaacgctcaacttaagaactaa

SEQ ID NO: 11039 - RNA, 3156 nt, synthetic construct
  misc_feature 1..3156: note = Cas13a variant__Listeria newyorkensis__WP_036091002.1__Cas13a
  source 1..3156: mol_type = other RNA
atgaaaattaccaagatgcgcgtggatggtcgtacgattgtgatggaacgtacttcgaaagaaggacagctgggctatgaaggcatcgacgggaacaaaacgactgagattattttcgataaaaagaaggaatctttttacaagagcattttgaacaaaaccgtccgcaaaccggacgagaaagagaaaaatcgccgcaaacaagcaattaacaaagcaattaataaggagatcacggagttaatgctggccgtgcttcatcaagaggtgccttcgcaaaaactgcacaacttaaagtcacttaacacggagtcgttaacgaaattattcaagcctaagttccagaatatgattagttaccctccttccaaaggcgctgagcatgtgcagttttgcttaacagatattgcggttccggcaatccgtgatcttgatgagattaagccggattggggtatcttttttgaaaaacttaagccttacaccgattgggctgagagctacatccattacaaacaaacaaccattcaaaagtcgattgagcagaacaagattcaatcaccggactccccgcgcaagttggtattgcaaaaatatgtcactgccttcctgaatggtgagccccttggattagatttggtcgctaagaagtataaattagccgacctggctgagagtttcaaactggtcgaccttaatgaggataaatcagcgaattacaaaattaaagcctgtcttcagcagcaccagcgtaacatcttggatgagttaaaggaagatccagaacttaaccaatatggtattgaagtcaaaaagtacattcagcgttacttccctattaaacgtgcaccaaatcgctccaaacatgcacgtgcagacttcttaaagaaagaattaattgaatcgacagtggaacaacaattcaaaaacgcggtctatcactacgtattggaacagggaaaaatggaagcatacgaacttactgaccctaaaactaaagatcttcaggacattcgcagcggagaagcattctcatttaaattcatcaacgcgtgcgcattcgcaagcaacaacttaaagatgattcttaatccggagtgcgaaaaagacattctgggcaaaggcaacttcaaaaaaaacctgcccaattcaacgacgcgttctgacgtcgtaaaaaaaatgattccttttttcagtgacgaactgcaaaacgtgaattttgacgaggccatctgggccatccgtggctcaatccaacaaatccgtaatgaagtgtatcactgtaagaagcattcttggaaatcgatccttaagattaaaggctttgaatttgaaccgaataacatgaaatacgcagattccgatatgcaaaagcttatggacaaagacatcgccaagattccggagtttattgaggaaaaattgaaatcatcaggcgtagtgcgtttttaccgtcatgacgagctgcaaagcatttgggaaatgaagcaaggtttctcgctgcttactacgaacgcgccgttcgtgccctcgtttaaacgcgtgtatgcgaaggggcatgattatcaaacaagcaagaaccgctactacaatctggaccttacaaccttcgacatcttggaatacggagaagaagactttcgtgctcgctatttcttaactaagcttgtatactatcaacagttcatgccttggtttactgccgataataacgcctttcgcgacgcagccaattttgtgttacgcttaaataaaaatcgtcagcaggatgcgaaagcattcatcaacatccgcgaagttgaagagggagagatgccgcgcgattacatgggttatgttcagggccaaatcgcgatccatgaagattcgattgaggatactcctaaccatttcgaaaagtttatcagtcaagtttttattaaaggttttgaccgtcacatgcgttccgcgaatttgaaattcatcaagaatccacgcaatcaaggccttgaacagtcggagattgaagaaatgtcgttcgacatcaaggtagagccttcctttctgaaaaacaaggatgactacattgctttttggattttttgtaaaatgctggatgcccgccacttatcagaattacgtaatgagatgattaagtatgatggacacttgacgggagaacaagagatcattggtttagcgttactgggtgttgacagccgcgagaacgactggaagcagtttttttcctcagagcgcgaatatgagaaaatcatgaagggctacgtcgtggaagaactttatcagcgcgagccatatcgtcagtcagatgggaagacgcctatcttattccgtggcgtggaacaggcacgcaaatatggtacagaaaccgtgattcaacgcctttttgacgccaatcccgaatttaaggtcagcaaatgtaacttagccgagtgggagcgccaaaaagagaccattgaagagacaatcaaacgccgcaaggaattgcacaatgaatgggccaagaaccctaagaaaccgcagaacaatgcgttcttcaaagagtataaagaatgctgcgatgctatcgatgcctacaattggcataagaataaaaccacattggcctatgtaaatgaactgcatcacttacttatcgaaatcttggggcgctatgttggctatgttgcgatcgcggatcgcgatttccagtgtatggccaatcaatactttaagcactcaggcattaccgaacgtgtcgaatactggggagacaatcgccttaaaagcattaaaaagttggacacttttctgaagaaagaaggtctttttgtaagtgagaagaacgcccgcaaccatattgcgcatttaaactacctgtcattaaagtctgagtgtactcttttatacctttccgagcgcttacgtgagatcttcaaatacgatcgtaagcttaaaaacgcagtttcaaaatccttaattgacattcttgatcgccatgggatgtcagttgtctttgccaaccttaaagaaaacaaacaccgcctggttatcaagagtttagaaccaaagaaacttcgtcatttaggtgggaagaaaatcgatggcggatacattgagactaaccaagtaagcgaggagtattgcggaatcgtgaaacgtttgcttgaaatgtaa

SEQ ID NO: 11040 - RNA, 3363 nt, synthetic construct
  misc_feature 1..3363: note = Cas13a variant__Listeria seeligeri__WP_012985477.1__Cas13a
  source 1..3363: mol_type = other RNA
atgtggatcagcatcaagaccttaatccatcaccttggggtcctgttcttctgcgactatatgtacaatcgccgtgagaagaaaattattgaagtcaagacgatgcgtattaccaaagtagaagtggatcgcaaaaaggtgcttatctcccgcgataagaatggtggaaaactggtttacgaaaatgagatgcaggataatacggagcagatcatgcaccacaaaaagtcctcattttacaagtctgtcgtcaataaaacaatttgccgtccagagcaaaaacaaatgaaaaagttagtgcatgggcttttacaggaaaactctcaagagaagatcaaagtatcggatgttaccaagcttaacatctcgaactttcttaatcatcgcttcaaaaaaagcctttactacttcccggaaaattctccggataaaagcgaggagtaccgcattgagattaatttaagtcagttgcttgaagattcgctgaagaagcagcaggggacctttatttgctgggagagcttttcaaaagacatggagctgtacattaattgggccgaaaattatatttcgagcaaaaccaaacttattaagaaatctattcgtaataatcgtatccagtctacggaaagccgttccggacagttaatggatcgctacatgaaagacatcctgaacaagaataagccttttgacattcagtcagtctcggaaaagtaccagttggaaaaattaacttcggcactgaaggctacctttaaggaggctaagaagaatgacaaggagattaactataaattaaagagcacgctgcagaaccatgaacgccagatcatcgaggaattaaaagagaactccgaacttaaccaattcaacatcgaaatccgtaagcatcttgagacctacttccccatcaaaaagaccaaccgtaaggtaggcgacattcgtaacttagagattggggaaattcagaaaatcgtcaaccatcgtttgaagaataagattgtccaacgtatccttcaggaaggaaagcttgcgtcgtacgagattgaatcaacggtaaactctaactcgttacagaagatcaagattgaggaggcgttcgcacttaagttcattaatgcttgtctttttgcctcgaacaatttacgtaacatggtttacccagtctgcaaaaaagacattttgatgattggggagtttaagaactcctttaaggaaatcaagcataagaagttcattcgtcagtggtcccaattctttagccaggagatcactgtcgatgacattgagttggcctcatgggggttacgcggagcaattgctccgattcgtaacgaaatcattcatttaaagaaacatagctggaagaaatttttcaacaatcccactttcaaagtcaaaaaatctaagatcattaacggaaagaccaaggatgttaccagtgaattcctttataaagaaacactgtttaaagattacttttattctgaattggattctgtgcccgagttgatcatcaataagatggaatcttcgaaaatcttggactattactcaagcgatcagcttaaccaggtcttcacaattcccaatttcgagttgagcttgttgacatcggccgttccttttgcgccatcctttaaacgtgtatatcttaaaggttttgactatcagaaccaggatgaagcacagcctgactacaatttgaagctgaatatttacaatgagaaagctttcaatagtgaagcttttcaggctcaatatagcttattcaaaatggtttattatcaagtgttccttccgcagttcaccactaataacgatctttttaaaagctcagtcgatttcattttgactttgaacaaagaacgcaaagggtacgcgaaggcctttcaggatattcgcaaaatgaataaagacgaaaaaccttctgagtacatgtcgtacattcagtcgcagctgatgttgtaccagaagaagcaggaagagaaagaaaaaatcaaccattttgagaaatttatcaaccaagtgttcattaaggggtttaactcgtttattgagaaaaaccgtctgacttatatctgtcatccaacaaagaatactgtcccggagaatgataacattgaaatcccatttcacacggatatggatgattcaaacatcgcattctggctgatgtgcaaattactggatgcgaaacaacttagcgaattacgtaatgagatgattaagttctcctgttctttacaatctaccgaggaaatttccacattcactaaagctcgtgaagtgattggtctggctttacttaacggggagaaaggctgcaatgactggaaagagttatttgacgataaagaggcatggaagaaaaacatgtcactgtatgtgagcgaggaacttcttcagtcattaccctatacccaggaggatgggcagacgccagttatcaaccgttccatcgatctggttaagaaatacggtacggagaccatcttagagaaattgtttagttcatcagatgactataaagtctcagcgaaggacatcgcaaagttacacgagtacgacgtaactgaaaagatcgcacaacaagagagtttacataagcagtggatcgaaaagcctgggcttgctcgcgactcggcatggaccaaaaaataccagaatgtaattaatgatatttcgaattaccagtgggctaagactaaggtggagcttacccaggttcgtcaccttcatcagttgaccatcgatttattgtcccgcttagctgggtatatgtctattgcagatcgcgatttccagttctccagtaattatatcttggaacgtgaaaatagtgagtaccgcgtaacgagctggatccttttatctgaaaacaagaacaagaataagtataatgactatgaactgtataatcttaagaacgcttcaatcaaagtcagcagcaaaaatgaccctcagcttaaagttgatttaaaacagttgcgtttaacgttggagtacttagagcttttcgacaaccgcttaaaggagaagcgtaataatatttcgcacttcaactaccttaacggacagcttggtaacagcatcttggaattattcgacgacgcccgcgatgtactgtcttatgatcgcaaattaaagaatgccgtctcgaaatcattaaaagaaatcctttcttcacacggtatggaagtaacgtttaagccgctttatcaaacaaaccaccatttgaaaatcgacaagttgcaacccaaaaagattcatcacttaggtgagaaaagtacggttagttcgaatcaagtatctaatgaatactgccagttagttcgtactttgcttaccatgaaataa

SEQ ID NO: 11041 - RNA, 3465 nt, synthetic construct
  misc_feature 1..3465: note = Cas13a variant__Paludibacter propionicigenes__WP_013443710.1__Cas13a
  source 1..3465: mol_type = other RNA
atgcgtgtgtcgaaagtgaaagttaaagatgggggcaaagacaagatggtcttggtccatcgtaagacgaccggtgcccaacttgtttattcagggcagcccgttagcaacgagacgtctaatattctgccagaaaaaaagcgccagtcattcgaccttagcaccctgaacaaaacaattatcaaattcgatactgcgaaaaagcaaaagttaaatgtggaccagtataagatcgtagaaaagatcttcaagtatcccaagcaggagctgcccaagcaaattaaagcagaggagatcctgccgtttttgaatcacaaattccaggagccagtcaagtattggaaaaacgggaaggaagagagcttcaatttaacattattgatcgtcgaggcagtccaagcacaggacaagcgtaaacttcagccctattatgactggaagacctggtacatccaaactaaaagcgatttactgaagaagagtatcgagaacaatcgtatcgatttgactgagaacttgtcaaagcgcaagaaggcattgttggcctgggagacagagttcacagcatccggttcaatcgacctgacgcattaccataaggtctatatgacggatgttctgtgcaaaatgttacaagatgttaagccgctgacagatgataaagggaagatcaacaccaatgcgtatcatcgtgggcttaagaaagccctgcagaaccaccaaccagccatctttggaacacgcgaggtgcctaatgaggctaatcgtgcagacaatcagttgagcatttatcatttggaggtcgtgaagtatcttgagcactattttccaattaaaacttcgaaacgccgcaataccgccgacgatatcgctcattatttaaaggcacagacgttgaagacaacgattgaaaagcagctggtaaacgccatccgcgcgaacatcatccaacaaggcaaaaccaatcatcacgagttgaaagcggacacaacatcgaatgatttgatccgtattaaaactaacgaagccttcgtcttaaacttaactggtacctgtgcgtttgcagcgaacaatattcgcaacatggtggacaacgagcaaactaacgacatcctgggaaagggggactttatcaagagcttactgaaggacaatacgaacagccaattgtactcgtttttttttggtgaaggattatccacgaataaggcagagaaagagacgcaactttggggtatccgtggggctgttcaacagatccgcaataatgtaaatcattacaagaaagacgcccttaaaaccgtgttcaacatctcaaatttcgagaatcccaccattactgacccgaaacaacagactaactatgcagacaccatctataaagcgcgcttcatcaatgaattggaaaagatccctgaagcctttgcacagcagcttaaaactggcggtgctgtctcctattacactatcgaaaacctgaaatcattattgactacgtttcagttttcgctgtgtcgtagcacgattccatttgcacctggtttcaaaaaggtttttaatggaggaatcaattaccaaaacgccaagcaagatgaatctttctatgagcttatgctggaacaatacttgcgtaaagagaatttcgccgaagagagctacaatgcacgttattttatgctgaagttgatctataacaatcttttcctgccgggctttacgaccgaccgtaaggcgttcgccgacagtgtgggatttgtgcaaatgcagaacaaaaagcaagctgagaaagtcaaccctcgcaagaaagaggcgtatgcgttcgaggcggtacgtccgatgaccgcagcagactctatcgcagattacatggcatacgttcaaagtgaattaatgcaggagcaaaacaaaaaggaggaaaaagttgccgaggaaactcgcatcaattttgaaaagttcgtccttcaggtgttcattaaagggttcgattcgttcttgcgcgccaaagagtttgacttcgtccaaatgccacaacctcaattgactgctacggcgtccaaccaacaaaaagccgacaagttaaaccaactggaagcctctattactgctgattgcaaacttacgccccaatatgcgaaagcggacgatgctacacatatcgcgttctacgtcttttgcaaattactggatgcggcacacttgtctaatttgcgtaacgagctgattaagtttcgcgaatccgttaacgaattcaaattccaccatttgctggaaatcattgagatttgccttttatctgcagatgttgtgccaacagactatcgtgatctttatagtagcgaagctgactgcttagcacgtctgcgcccgttcattgaacagggcgcagacatcacaaactggtcagacttatttgtacaatctgacaaacacagcccagtcatccacgcaaacattgagcttagtgttaaatatggcacaactaaactgttagagcagattatcaataaagatactcaattcaagaccacagaggcaaattttaccgcctggaatactgcgcagaagagcatcgaacagcttattaagcaacgcgaggaccatcacgagcaatgggtcaaggctaaaaacgccgacgacaaagaaaaacaagagcgcaaacgcgagaagtccaactttgcgcaaaagtttattgagaaacacggtgacgattatcttgatatctgcgattatatcaacacttataactggcttgacaataaaatgcacttcgtgcacctgaaccgtctgcacggcttgactatcgagcttttaggtcgcatggccgggtttgtcgccctgtttgatcgcgattttcaatttttcgatgagcaacagatcgctgacgagttcaagttacacggatttgtgaacttacacagtattgacaagaagctcaatgaagtccctactaaaaagatcaaagagatctacgacattcgtaacaaaatcattcaaattaacggaaacaagatcaatgagtccgtgcgtgccaacttaattcaatttatctcgtctaaacgtaattactataataacgccttcttgcacgtgtccaatgatgagatcaaagaaaagcagatgtatgatatccgcaaccatatcgcgcacttcaactatttgacgaaggacgcggctgacttctctttgattgacttgattaacgagcttcgcgaattgttacattatgatcgcaaacttaagaacgctgtttccaaggcctttatcgacctgtttgataagcacggcatgattctgaagcttaagcttaacgcagaccacaagttaaaggttgagtccctggagccaaagaaaatttaccatctgggatcatctgcgaaggacaagccggagtatcaatattgcaccaaccaagtcatgatggcatactgtaacatgtgccgctcccttttagagatgaaaaaataa

SEQ ID NO: 11042 - RNA, 3858 nt, synthetic construct
  misc_feature 1..3858: note = Cas13a variant__Rhodobacter capsulatus__ETD76934.1__Cas13a
  source 1..3858: mol_type = other RNA
atgcagattggaaaagttcaaggccgcacgatttccgagttcggcgaccctgctggcggcttaaaacgtaaaatttcgacagacggtaagaatcgcaaagagttgcctgcacatcttagctcagatccgaaggctctgatcggtcagtggatcagtgggatcgataaaatctatcgcaagccagattctcgtaagtcggacggcaaggctattcacagccccactccgtcgaagatgcagtttgatgcacgtgacgacttaggtgaagccttctggaaacttgttagcgaagccgggttggcccaagattcggattacgaccaatttaaacgtcgtcttcatccatatggggacaagttccaacctgcagactcgggagctaaattgaagttcgaggcggacccaccagaaccgcaagcgtttcacggccgctggtacggtgctatgagcaaacgcggaaatgacgcgaaagagctggcagctgcattatacgagcatcttcatgtcgacgaaaagcgcatcgacggtcagccaaaacgcaaccccaagacggataaatttgcgcccggattagtcgtggctcgcgctctgggtattgagtcctcggttttaccgcgtgggatggcgcgtcttgcacgtaattggggcgaggaggaaattcaaacttatttcgtcgtcgacgtcgcagctagcgtaaaagaagttgcgaaggcggccgtatcggccgctcaggctttcgaccctccacgtcaagtttcgggccgttcgctttcacccaaggtaggttttgccttagctgagcatctggaacgcgtcactggtagcaagcgttgtagctttgaccctgctgcaggccccagtgtattggcgctgcatgatgaggtaaagaaaacttacaagcgtttgtgcgcgcgtggtaagaatgctgcgcgtgcgtttcccgctgacaaaacggaattgttagcattgatgcgccatacccatgaaaaccgcgtgcgtaaccagatggtgcgtatgggacgcgtcagcgagtaccgtgggcaacaagccggtgacctggcgcagtcacattattggacgagcgcaggacaaactgaaattaaggagtctgaaatctttgtccgtctttgggtaggtgcctttgccttagctgggcgttccatgaaagcatggattgaccccatgggaaagattgtaaacacagaaaagaatgaccgtgatttgactgccgctgtgaatatccgccaagtgatctccaataaagaaatggtggcagaagctatggctcgtcgcggtatttactttggcgagactccggaattggatcgcttgggggcggaaggcaatgaaggatttgtttttgcgttattacgttatttacgtgggtgtcgtaaccagaccttccatctgggcgcacgtgctggttttttaaaagaaatccgcaaggagcttgaaaagacacgttgggggaaggcaaaagaggcggagcacgttgtgttaacagataagacggtagctgcaatccgtgcgattattgacaatgatgcgaaggctttaggagcacgcctgctggccgacttatccggagcatttgtagcgcactacgcatctaaagagcatttttcgaccttgtactctgagatcgttaaggctgtcaaggacgctcccgaagtctcgtcaggattgccccgcttgaaactgctgcttaagcgcgccgacggggtgcgcgggtatgttcatgggttgcgtgacactcgtaagcatgctttcgccaccaaattgcccccaccaccggcgccacgtgagcttgacgacccagctaccaaagcacgttatattgctttgctgcgcctgtatgacggtccatttcgcgcctatgcgtcaggcatcacagggacggctttggccggacccgcggcgcgtgctaaggaagctgccactgcccttgcacaaagtgtcaacgttaccaaagcatattcagatgttatggaggggcgctcttcacgcctgcgcccgcccaacgacggtgagaccctgcgtgagtacttaagtgctttaacgggcgagactgcgaccgaattccgtgtccaaatcggatacgagtcggattctgaaaacgcacgcaaacaagcggaatttattgagaattatcgccgtgatatgttggcttttatgtttgaggattacattcgcgctaaaggttttgattggatcttaaaaatcgaaccgggagccacagcaatgacccgtgcaccagtgctgcctgaacctattgacacacgtggacaatacgaacattggcaggcggcattgtatctggttatgcattttgtgcccgcgtccgacgtaagtaatcttcttcatcagttacgtaaatgggaggctcttcaaggtaaatatgaattagtacaggatggcgacgcaaccgaccaagcggatgcacgtcgtgaggctttggatttagttaaacgtttccgcgacgttttggtactttttcttaagacaggagaggcacgcttcgaaggccgcgcggctccctttgatttgaagcctttccgtgctttgttcgcgaaccccgcgacttttgaccgcctgttcatggccacacctacaaccgcacgtccggcggaagatgaccccgaaggtgacggggcaagcgaacccgaacttcgcgtcgcacgcacgctgcgcggacttcgccagatcgcgcgctacaaccacatggcagttttgtcggatcttttcgcgaaacataaggtgcgcgatgaagaagtggcccgcttagccgaaattgaggatgagacgcaggaaaaatcccagattgttgcggcacaggaactgcgtacggatttgcatgacaaggtaatgaagtgccatccaaagacgattagtcctgaagaacgtcagagttacgcggccgccatcaagaccatcgaggagcatcgttttctggttgggcgtgtgtacttgggagatcatttacgtttgcatcgtctgatgatggatgtgatcggacgtttgatcgactatgcaggcgcctatgaacgtgataccggcacgtttcttattaatgcttcaaagcaattgggtgctggagccgactgggctgtcacgatcgctggtgcggcgaacacagacgctcgtacacaaacgcgtaaggaccttgcgcactttaatgtgttggaccgtgcagatggcactcccgatttaaccgcgttggtgaaccgcgctcgtgagatgatggcttacgaccgtaaacgcaagaatgctgtacctcgctcaattttagatatgctggctcgtctgggattgactttaaaatggcaaatgaaagatcatttgttgcaagacgctactattacccaggcggccatcaagcacttagacaaggtgcgcttgaccgtcggaggccctgccgcagtaactgaagcccgtttcagccaagactacttgcagatggtagctgctgtatttaatggaagtgtacagaatcctaagcctcgccgtcgcgacgatggtgacgcctggcacaagccacccaagccagccacggcgcaaagtcaacctgaccaaaagccacccaacaaagcgccttccgctggttctcgtcttccgcctccccaagttggtgaggtgtacgaaggggtagttgtgaaggtcattgacacaggctcacttgggttccttgccgtggagggggtcgcaggcaatatcggtcttcacatctcacgtcttcgtcgtattcgtgaagacgcgattattgtaggacgtcgttatcgctttcgcgtagagatttatgtgcctcctaagtcgaatactagcaagttaaacgctgcggacctggttcgtatcgattaa

SEQ ID NO: 11043 - RNA, 1578 nt, synthetic construct
  misc_feature 1..1578: note = Cas13a variant__Corynebacterium ulcerans__WP_038617242.1__Cas13
  source 1..1578: mol_type = other RNA
atgccaaaatattgtctcactgcaagattcccgctgggggtctatctggggcataccggcgacgctaaccgagacgcatatccggatccggctcggttgcacgcggcgcttatgaatgcggcagctcaaggtgttcatgcagaagaagatccaaacgaacaccaactcaggcccagtcaacaatcgctacaagcactgcagtggttagaagcacatccccccaccggtttagcgatgcctgagcagcaatggctctccccagatacatcacgaatgatgtaccgaaacgtaggctcagtgaagatcgacaaaaccggcgtaacgcgtgctaccgagaatcgtgctgtctccgatggcgtatccgtcaatggagcttatgggtatatctgggacgagatgcccgtggatatagcagaagccattaccgcattgctccccgatgtcgcatgcctaggagaagcttcttctctcgtagtacttgaacagcaagaaatcgaagccacgcttactcttgatcctcaagcgaccgctttttcaaccgaacgcgttcaagtccgaatagcgctgcctggacgcactcagcacctcagagaagtgttccatgcacggtatggaaagaagcctccttccaaaaaagcggacaagttcttaaaggatgacccgatccatgatcctccgatccccaaagatcacttaggtacggctcgctatctacgtgtcaacgctgcggataaggaatgcgtgacaccctggacaaaagtcattttgttggaggtacacggtaaacagctaggggcgaaagaacaggttcgcgcagctgttgccctccatcgagcacttattgccagaattagaacggatgtctcgccagttatcactgggcgttatgcagctggggcacaaagaccagcaaataatttagccatccaatacataccgcatcgtcacttagaagcgcttggattgaaaacctcagcgttcgcgcttcttgtcccccaagatgctgattccactgtgtacgaacaactcaaccaagcactcaccggaccttttccactcagaagtggtggaaaactcttgtgccagcttaagtacaacggtcacgtattcagaggcgatgcattttggccagctcctcaaccaggaactatccgtatgtgggagccattaaacgtctttatcccagaatcgcgaccccacaataagcaacaaggtgtgctgtggcgcctggcggatgcaggcttactctcagtggccttcgtctggcgcgacaacttcccgaccaaggaaactggccctgcacgctatgtcgaactacgcgacgcggcctataacgcagatgtacggatttttcatgatcaccccgtaagcagaaatacccgtcgctttgtccacaggaccaacaggagtttaaccatccaaccttggcgaggtctcgtgcacttggggagcctccagcaggatagagcgatcattgcactggggcaatcacgccatctgggcggaggtctgttaatccctgtggatattcccagaagtgaattcgaaacgatgacaagcgagatgactcatgcctag

SEQ ID NO: 11044 - RNA, 3675 nt, synthetic construct
  misc_feature 1..3675: note = Cas13b variant__Bergeyella zoohelcum__WP_002664492.1__Cas13b
  source 1..3675: mol_type = other RNA
atggaaaacaaaacatctttggggaataatatttattacaacccttttaaaccacaagataaatcgtattttgcgggttatttcaatgcagcaatggaaaatacagatagtgtatttagagaattgggaaaaagattaaaaggtaaagagtacacttcggagaatttttttgatgctatctttaaggaaaatatttcattagtggaatacgaaaggtatgtgaaattgctttctgattatttccctatggctcgtcttttggataaaaaagaagttcctataaaagaacgaaaagaaaattttaaaaagaattttaaaggcattataaaagccgtaagagatttaagaaacttttatacgcataaggaacacggagaggtagaaattacagatgaaatatttggcgtattggatgagatgctgaaaagcacggttttaacggtaaaaaagaaaaaagtaaaaaccgataaaacaaaagaaatcctgaaaaaaagcatagaaaaacaattggatattttatgccaaaagaaattagaatatctaagagacacagcaagaaaaatagaggagaagcgtagaaatcaaagagaaagaggagagaaagaattggtagctccattcaaatacagtgataaaagggatgatttaatagcagcgatttataatgatgcttttgatgtttatatcgataagaaaaaagatagcctaaaagaatccagcaaagcaaagtacaataccaaaagtgatcctcagcaagaagaaggcgatttgaaaattccaatttcgaaaaacggagtagtcttcctgctttctttgtttctcaccaaacaagaaatacacgcattcaaatctaaaatagcagggtttaaggctacggttatcgatgaagcaacggtatctgaagcaacggtgagccatggaaaaaacagcatttgttttatggctacgcacgaaattttctcgcatttggcttacaaaaaattgaaacgaaaagtgagaacggctgaaatcaactatggtgaggcagaaaatgctgaacagctttccgtttatgccaaagaaactctaatgatgcagatgcttgatgaattgagcaaagtacccgatgtggtctatcagaatttgagcgaagatgtacaaaaaactttcatcgaagattggaatgaatacctaaaagagaacaatggcgatgtagggacaatggaagaagagcaggtaattcatccagtgattcgcaagcgttacgaagataaattcaattattttgccattcgatttttagatgagtttgctcagttccctacgcttcgttttcaagtgcatttagggaattatcttcacgattctcgccctaaagaaaatctgatttctgaccgaagaataaaagaaaaaatcaccgttttcggaaggctttcggaattggaacataaaaaagcattgtttataaaaaataccgaaaccaatgaagatagagaacactattgggaaatttttcctaaccccaattatgattttcctaaggaaaatatttccgttaatgataaagattttcctatcgcgggtagtattttggacagagagaaacagcctgtcgcagggaaaattggtataaaagtgaaattgcttaaccaacaatatgtttcagaagtagataaagccgtaaaagcccatcagctcaagcaaagaaaagccagcaagccgtctatccagaacattatagaagaaatagtgccaatcaatgaaagcaatccaaaagaagctattgttttcggtgggcaacccacggcttatctgagtatgaatgacattcattccattttgtatgagtttttcgataaatgggagaaaaagaaagaaaagttagaaaagaaaggtgaaaaagaattaagaaaggaaattggaaaagagttagaaaagaaaatcgtaggaaaaattcaagctcaaatccagcaaatcatagataaagataccaatgccaagatattaaaaccttatcaagacggaaattctactgctattgataaagagaaattgataaaagatttgaagcaagagcaaaacattctacaaaaattaaaagatgaacaaacggttcgtgaaaaagaatataatgattttattgcttatcaagataaaaatagggagataaataaagtcagagatagaaatcataaacaatatttaaaagataaccttaaacgaaagtaccctgaagctcctgcacgaaaagaagttctttattatcgagaaaaaggaaaagtagcggtttggttggcgaatgacatcaaacgctttatgcctaccgatttcaaaaacgaatggaaaggggagcaacacagcttgttacaaaaatcgttggcgtattatgagcaatgtaaagaggagttgaaaaatcttttgcctgaaaaagtatttcagcatttaccttttaagttgggaggatattttcaacaaaaatatttgtaccaattttacacttgttatttagataaacggttggaatacatcagtgggttggtgcaacaagccgaaaactttaaatccgaaaataaagtcttcaaaaaggtagaaaatgagtgttttaaatttttgaaaaaacaaaattatactcacaaagaattagatgctcgggttcagtctatattggggtatcctatctttttagagcggggctttatggatgaaaaacctacgataatcaaaggaaaaacttttaaaggaaatgaagctctttttgccgattggtttaggtattacaaggaatatcagaattttcagacattttatgatactgaaaattatccgcttgtagaattggaaaaaaaacaagcagaccgaaaacgaaaaactaaaatctaccaacaaaagaaaaacgatgtgtttacacttttgatggcaaaacatattttcaaatcggtattcaagcaggatagcatcgatcagttttcgttagaagatttgtatcaatctcgggaggaacgcttaggaaatcaggagagagccagacaaacgggcgagcgaaatactaactatatttggaacaaaaccgttgatttaaagttgtgtgacggaaaaattacggtagaaaatgtaaagctaaaaaatgtaggagatttcataaaatatgaatacgaccaaagggttcaagctttcttaaaatatgaggaaaatatagaatggcaggcgtttctaatcaaagagagtaaggaagaggaaaattatccgtatgtggtggaaagagaaatagagcaatatgaaaaagtgagaagggaagaactgttgaaggaagtccaccttatagaggaatatattttggaaaaggtaaaagataaggaaatattaaaaaaaggggataatcaaaatttcaaatactacattctcaacggacttttaaagcaacttaaaaatgaagatgtggagagctataaggtattcaacttaaatactgaacctgaagatgtgaacattaaccaactaaaacaagaagcaaccgatttagaacaaaaagcttttgttttaacctatattcgtaataaatttgcacacaaccaattacctaaaaaagaattttgggactattgtcaagaaaaatacggcaaaatagaaaaagaaaaaacctatgccgagtattttgctgaggtatttaaaaaggaaaaagaagcactgataaagtaa

SEQ ID NO: 11045 - RNA, 3675 nt, synthetic construct
  misc_feature 1..3675: note = Cas13b variant__Bergeyella zoohelcum__WP_002664492.1 modified__Cas13b(R116A,H121A,R1177A,H1182A)
  source 1..3675: mol_type = other RNA
atggaaaacaaaacatctttggggaataatatttattacaacccttttaaaccacaagataaatcgtattttgcgggttatttcaatgcagcaatggaaaatacagatagtgtatttagagaattgggaaaaagattaaaaggtaaagagtacacttcggagaatttttttgatgctatctttaaggaaaatatttcattagtggaatacgaaaggtatgtgaaattgctttctgattatttccctatggctcgtcttttggataaaaaagaagttcctataaaagaacgaaaagaaaattttaaaaagaattttaaaggcattataaaagccgtaagagatttagcaaacttttatacggcaaaggaacacggagaggtagaaattacagatgaaatatttggcgtattggatgagatgctgaaaagcacggttttaacggtaaaaaagaaaaaagtaaaaaccgataaaacaaaagaaatcctgaaaaaaagcatagaaaaacaattggatattttatgccaaaagaaattagaatatctaagagacacagcaagaaaaatagaggagaagcgtagaaatcaaagagaaagaggagagaaagaattggtagctccattcaaatacagtgataaaagggatgatttaatagcagcgatttataatgatgcttttgatgtttatatcgataagaaaaaagatagcctaaaagaatccagcaaagcaaagtacaataccaaaagtgatcctcagcaagaagaaggcgatttgaaaattccaatttcgaaaaacggagtagtcttcctgctttctttgtttctcaccaaacaagaaatacacgcattcaaatctaaaatagcagggtttaaggctacggttatcgatgaagcaacggtatctgaagcaacggtgagccatggaaaaaacagcatttgttttatggctacgcacgaaattttctcgcatttggcttacaaaaaattgaaacgaaaagtgagaacggctgaaatcaactatggtgaggcagaaaatgctgaacagctttccgtttatgccaaagaaactctaatgatgcagatgcttgatgaattgagcaaagtacccgatgtggtctatcagaatttgagcgaagatgtacaaaaaactttcatcgaagattggaatgaatacctaaaagagaacaatggcgatgtagggacaatggaagaagagcaggtaattcatccagtgattcgcaagcgttacgaagataaattcaattattttgccattcgatttttagatgagtttgctcagttccctacgcttcgttttcaagtgcatttagggaattatcttcacgattctcgccctaaagaaaatctgatttctgaccgaagaataaaagaaaaaatcaccgttttcggaaggctttcggaattggaacataaaaaagcattgtttataaaaaataccgaaaccaatgaagatagagaacactattgggaaatttttcctaaccccaattatgattttcctaaggaaaatatttccgttaatgataaagattttcctatcgcgggtagtattttggacagagagaaacagcctgtcgcagggaaaattggtataaaagtgaaattgcttaaccaacaatatgtttcagaagtagataaagccgtaaaagcccatcagctcaagcaaagaaaagccagcaagccgtctatccagaacattatagaagaaatagtgccaatcaatgaaagcaatccaaaagaagctattgttttcggtgggcaacccacggcttatctgagtatgaatgacattcattccattttgtatgagtttttcgataaatgggagaaaaagaaagaaaagttagaaaagaaaggtgaaaaagaattaagaaaggaaattggaaaagagttagaaaagaaaatcgtaggaaaaattcaagctcaaatccagcaaatcatagataaagataccaatgccaagatattaaaaccttatcaagacggaaattctactgctattgataaagagaaattgataaaagatttgaagcaagagcaaaacattctacaaaaattaaaagatgaacaaacggttcgtgaaaaagaatataatgattttattgcttatcaagataaaaatagggagataaataaagtcagagatagaaatcataaacaatatttaaaagataaccttaaacgaaagtaccctgaagctcctgcacgaaaagaagttctttattatcgagaaaaaggaaaagtagcggtttggttggcgaatgacatcaaacgctttatgcctaccgatttcaaaaacgaatggaaaggggagcaacacagcttgttacaaaaatcgttggcgtattatgagcaatgtaaagaggagttgaaaaatcttttgcctgaaaaagtatttcagcatttaccttttaagttgggaggatattttcaacaaaaatatttgtaccaattttacacttgttatttagataaacggttggaatacatcagtgggttggtgcaacaagccgaaaactttaaatccgaaaataaagtcttcaaaaaggtagaaaatgagtgttttaaatttttgaaaaaacaaaattatactcacaaagaattagatgctcgggttcagtctatattggggtatcctatctttttagagcggggctttatggatgaaaaacctacgataatcaaaggaaaaacttttaaaggaaatgaagctctttttgccgattggtttaggtattacaaggaatatcagaattttcagacattttatgatactgaaaattatccgcttgtagaattggaaaaaaaacaagcagaccgaaaacgaaaaactaaaatctaccaacaaaagaaaaacgatgtgtttacacttttgatggcaaaacatattttcaaatcggtattcaagcaggatagcatcgatcagttttcgttagaagatttgtatcaatctcgggaggaacgcttaggaaatcaggagagagccagacaaacgggcgagcgaaatactaactatatttggaacaaaaccgttgatttaaagttgtgtgacggaaaaattacggtagaaaatgtaaagctaaaaaatgtaggagatttcataaaatatgaatacgaccaaagggttcaagctttcttaaaatatgaggaaaatatagaatggcaggcgtttctaatcaaagagagtaaggaagaggaaaattatccgtatgtggtggaaagagaaatagagcaatatgaaaaagtgagaagggaagaactgttgaaggaagtccaccttatagaggaatatattttggaaaaggtaaaagataaggaaatattaaaaaaaggggataatcaaaatttcaaatactacattctcaacggacttttaaagcaacttaaaaatgaagatgtggagagctataaggtattcaacttaaatactgaacctgaagatgtgaacattaaccaactaaaacaagaagcaaccgatttagaacaaaaagcttttgttttaacctatattgcaaataaatttgcagcaaaccaattacctaaaaaagaattttgggactattgtcaagaaaaatacggcaaaatagaaaaagaaaaaacctatgccgagtattttgctgaggtatttaaaaaggaaaaagaagcactgataaagtaa

SEQ ID NO: 11046 - RNA, 3384 nt, synthetic construct
  misc_feature 1..3384: note = Cas13b variant__Prevotella buccae__WP_004343973.1__Cas13b
  source 1..3384: mol_type = other RNA
atgcaaaaacaagataaattatttgtagatagaaagaaaaatgctatatttgcctttcctaaatatataacaataatggaaaacaaagagaaacctgaaccaatttattatgaattgacagataagcatttctgggctgcctttcttaacttggcgcgccacaatgtctataccaccattaatcacatcaacagacgtttggaaatagcagagctaaaagacgatggatatatgatgggcattaaaggcagctggaacgagcaagcgaaaaaactcgacaaaaaagttcggctgagagacttgatcatgaaacactttccttttctggaagctgcagcttatgaaatgacaaactctaaaagtcccaacaataaggagcaacgggaaaaggaacaatccgaagccctatcacttaacaacttgaagaatgttctattcattttcttggaaaaacttcaggttctcaggaactactactcccattacaagtattctgaagaatccccaaaaccgatatttgaaacaagccttttgaaaaacatgtataaggttttcgatgccaatgtgcggttagtaaagagagactatatgcatcatgagaatatagacatgcaaagagattttacacatctcaacaggaaaaaacaagtgggacgaacaaaaaacatcatagacagtcctaactttcattaccattttgcagataaagaaggcaatatgaccatagcaggcttactgttcttcgtctctttatttcttgataaaaaagacgctatttggatgcagaaaaagctaaagggatttaaagatggcagaaacttgcgtgagcaaatgacaaacgaagtattttgcagaagccgtatatctttgcctaagctaaaattagagaatgtacagacaaaagactggatgcaacttgatatgcttaacgaattggttcgctgtcccaaatcgctgtatgaacggttacgagaaaaagatagggaaagttttaaagtacctttcgatattttctctgacgactataatgctgaagaagaaccatttaagaacacgcttgtaaggcatcaagaccgctttccatattttgtcttgagatatttcgatttaaatgagatattcgaacaactccgcttccaaatagatttaggtacctatcatttctctatctataacaaacgtatcggtgacgaagatgaagttcgccatctcacacatcatctatatggctttgcgcgcattcaggactttgcaccacaaaaccaaccagaagaatggagaaaattagtgaaagacttagatcattttgagacatcgcaagagccttacatatctaagactgctccacattaccatttagagaatgaaaagataggcattaagttttgcagtgcccacaacaacctctttccatctcttcagaccgacaaaacatgcaatggaagaagtaaatttaatctcggaacacaatttacagcagaagcatttttaagtgtccacgaattgttgccgatgatgttttattatctgttattgaccaaggattactccagaaaagaaagcgcagacaaagtagagggaattataagaaaagaaataagcaacatatacgctatctacgatgcttttgccaataatgagataaatagcattgcagacttaacccgtcggcttcaaaatacaaatatactacaaggccatttgccaaaacaaatgatttccatattgaaaggcagacaaaaagatatgggaaaagaggctgagcgcaaaattggggaaatgatagacgacacccaaagaagacttgacttgctctgcaagcagacaaatcagaagataaggattggcaaaaggaatgccggtctgctaaaatcgggaaaaattgcagattggttggtaaatgacatgatgcgcttccaacctgttcaaaaagaccaaaataacattccaataaacaatagcaaggctaacagcaccgaatatcgaatgcttcagcgtgcgcttgcccttttcggcagtgagaacttccgccttaaggcatattttaatcaaatgaatcttgtggggaatgacaatccgcatcctttccttgcagaaacacaatgggaacatcaaactaacattctgtctttctaccgaaactatttggaagcgaggaaaaagtatcttaagggcttaaaaccacaaaactggaaacaatatcagcattttctcatacttaaagtacagaagaccaaccgcaacacattagttacaggatggaaaaacagtttcaatctcccccgtggaatatttacccaaccaataagggaatggtttgagaaacataataattcaaaaagaatatacgaccaaatactatcttttgaccgagtagggtttgttgcaaaagctattcccttatactttgcagaagaatataaagacaatgtacagcctttctacgattatccgttcaatatcggcaacagacttaaaccaaaaaaaaggcaattcttagataaaaaagagcgtgtcgaattgtggcaaaagaataaagagctattcaaaaattatccgtctgaaaagaaaaagacagacttagcttatcttgattttttatcatggaaaaagttcgaacgcgaactgcgacttatcaagaatcaggatatcgtcacatggttgatgttcaaagaactattcaatatggctactgtggaaggattgaagattggagaaatacatctgagggacatcgatacaaacacggcaaatgaggaaagcaacaatattctaaatagaatcatgcccatgaagttgcctgttaaaacatacgaaacagacaataaaggaaatatattaaaggaaagacctttagcaaccttttatatcgaagaaacggaaaccaaagtcctgaaacagggcaatttcaaagcattggtaaaagaccgaagactcaatgggctattctcatttgcagaaactacagacttgaacttagaggaacatcctatcagcaaattgagtgtagaccttgagcttataaaatatcagactacaaggattagtatctttgagatgacattaggactggaaaagaaactcatagacaaatattccacactacctacagatagcttcagaaatatgcttgaaaggtggttgcagtgcaaagctaatagaccggaattaaagaattacgttaatagtttgattgcagtgagaaatgctttttcccacaaccagtatcccatgtatgatgccacactctttgctgaagttaaaaaatttactcttttcccttctgtcgatacaaaaaagattgagctaaatatagcgccacagttactggaaatagtaggaaaagccataaaagaaattgaaaaatcagaaaataaaaactaa

SEQ ID NO: 11047 - RNA, 3273 nt, synthetic construct
  misc_feature 1..3273: note = Cas13b variant__Prevotella sp.__WP_044065294__Cas13b
  source 1..3273: mol_type = other RNA
atgaatatacctgcattagtggaaaaccagaagaagtatttcggtacatactctgtcatggcaatgctgaacgcacagaccgtactcgaccacatacagaaagtggcagacatagagggggaacagaacgagaacaacgaaaatctatggttccaccccgtaatgagccatttatacaatgcgaagaatggatatgacaaacagccggaaaagactatgttcatcatcgaacgtctgcagtcatattttcctttcctcaagattatggctgaaaaccaaagagagtattcgaacggaaaatacaaacagaatagggttgaggtgaacagcaacgacatctttgaagttctgaaaagggctttcggcgtgctgaaaatgtatcgcgacctaaccaaccattacaaaacctacgaagaaaagctgaacgacggctgcgagtttctgacgagtactgagcagcctctttccggaatgataaacaactactacactgtagccctgcgaaacatgaatgagcgttatggatacaaaaccgaagacctcgcctttatacaggacaaaagattcaaattcgtcaaagacgcatacggaaaaaagaaatcacaagtaaataccggtttcttcctcagtctgcaagactacaacggcgacacacaaaagaaactccacttgtctggagtcggcatagccttgcttatctgtctgttcctcgacaagcagtatatcaacatcttcctgtcaaggcttcctatcttctcttcctataatgcacaatcggaagagcgacgcatcatcatccgttcttttggcataaacagcatcaaactgcccaaagaccgcatccactctgaaaagagcaacaagtcggtggctatggatatgctgaatgaggtgaagcgttgtccggacgaactgttcactaccctctcggctgaaaagcagtctcgattcagaattatttccgacgaccacaacgaggtgcttatgaaacgtagttccgacagattcgtgccattgctattgcaatatattgactacggcaagctgttcgaccacatccgttttcatgtgaatatggggaaactgcgctatctgctcaaagccgacaagacctgcatcgacggtcagacacgagtgagggtgatagaacagcctctcaacggtttcggaagattggaagaggctgaaacgatgcgaaagcaagaaaacggaactttcggcaatagcggcattcgcattcgcgattttgagaacatgaaaagagacgacgccaatccggcaaactatccatatatcgtggacacatatactcactatatattggagaacaacaaggtggaaatgttcataaacgataaagaagactcagccccattgttgcctgtgattgaggatgacagatatgtggtaaagaccattccatcctgccgtatgagcactcttgaaatacctgccatggcatttcatatgttcctgttcggtagcaaaaagaccgaaaagcttattgtcgatgttcacaacaggtataagagattgttccaagcgatgcaaaaagaagaggtaacagctgaaaacatagcctctttcggcattgctgaaagcgatctgccccagaagattcttgatctcatcagcggaaatgctcatggcaaggatgttgacgccttcatcaggcttaccgtcgacgacatgcttaccgataccgaacggcgcatcaagagatttaaagacgaccgcaaatccatacgttctgccgacaacaagatgggcaagcgcggtttcaaacagatttctacaggtaagctggcggatttcctcgccaaagacatcgttttgttccaaccttctgtaaatgatggcgagaacaagattacgggattgaactaccgcatcatgcagtctgccatcgccgtttacgacagtggcgacgattatgaagccaagcaacagttcaagctgatgtttgagaaagcccggctcatcggcaaaggcacaacagagcctcatcctttcttatataaggtctttgcgagatctatccctgccaatgccgtggagttctatgagaggtatcttatagagcgcaaattctatctcaccggactctccaacgagataaagaagggaaacagggtggatgtgcctttcatcagacgtgaccagaacaaatggaaaacaccagcgatgaagactctcggcagaatctactctgaagacctgccggtggagttgcctcgacagatgtttgacaacgaaatcaagagccacctgaaatcgctgccacagatggagggcattgatttcaacaatgccaacgtcacgtatctcattgcggaatatatgaaacgggtattggatgatgatttccagacattctaccaatggaaccgcaactatcgctatatggacatgctgaagggtgaatacgacaggaaaggttcgctgcagcactgcttcacatccgtagaagaaagagaaggtttatggaaagaacgtgcaagccggactgaacgctacaggaaacaggcttcaaacaaaatcaggtctaacagacagatgcgtaatgcctcttctgaagaaatcgaaacgatattagacaagcgtttgagtaacagccgcaacgaataccagaaaagtgagaaggtgatccgcagatacagagtacaggatgccctgctcttcttattggcaaagaagactctgacggaactggcggatttcgacggcgagagattcaagctgaaagagattatgcctgatgcagaaaagggaatcctgtctgagattatgcctatgtcattcacttttgaaaagggcggcaagaaatataccataacatcggaaggcatgaagctgaagaactatggtgatttcttcgtcttggcaagcgacaagagaatcggcaacttgttagaacttgttggctccgacattgtatccaaggaggacatcatggaagaattcaataagtatgaccaatgccgacctgaaatatcgagcatcgtattcaacttagagaaatgggcattcgacacttatcctgagttgtcagcgagagttgacagagaagaaaaggttgatttcaagtccatcttaaagattctcctaaacaacaagaatatcaataaagaacaaagtgacatattgcgaaaaatcaggaatgctttcgaccacaacaactatcccgacaaaggtgttgttgagataaaggctttgcctgaaattgccatgagcataaagaaagcattcggagaatatgccatcatgaaatag

SEQ ID NO: 11048 - RNA, 4152 nt, synthetic construct
  misc_feature 1..4152: note = Cas13b variant__Artificial____PspCas13b-GS-HsADAR2DD(E488Q,del984- 1090)
  source 1..4152: mol_type = other RNA
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatggatcccttcaactgcctccacttgaaagactgacactgggatcccagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtcaggggacgattccagtgcgctccaatgcgagcatccaaacgtgggacggggtgctgcaaggggagcggctgctcaccatgtcctgcagtgacaagattgcacgctggaacgtggtgggcatccagggatcactgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgtaa

SEQ ID NO: 11049 - RNA, 4152 nt, synthetic construct
  misc_feature 1..4152: note = Cas13b variant__Artificial____PspCas13b-GS-HsADAR2DD(E488Q,T375G,d el984- 1090)
  source 1..4152: mol_type = other RNA
atgaacatccccgctctggtggaaaaccagaagaagtactttggcacctacagcgtgatggccatgctgaacgctcagaccgtgctggaccacatccagaaggtggccgatattgagggcgagcagaacgagaacaacgagaatctgtggtttcaccccgtgatgagccacctgtacaacgccaagaacggctacgacaagcagcccgagaaaaccatgttcatcatcgagcggctgcagagctacttcccattcctgaagatcatggccgagaaccagagagagtacagcaacggcaagtacaagcagaaccgcgtggaagtgaacagcaacgacatcttcgaggtgctgaagcgcgccttcggcgtgctgaagatgtacagggacctgaccaacgcatacaagacctacgaggaaaagctgaacgacggctgcgagttcctgaccagcacagagcaacctctgagcggcatgatcaacaactactacacagtggccctgcggaacatgaacgagagatacggctacaagacagaggacctggccttcatccaggacaagcggttcaagttcgtgaaggacgcctacggcaagaaaaagtcccaagtgaataccggattcttcctgagcctgcaggactacaacggcgacacacagaagaagctgcacctgagcggagtgggaatcgccctgctgatctgcctgttcctggacaagcagtacatcaacatctttctgagcaggctgcccatcttctccagctacaatgcccagagcgaggaacggcggatcatcatcagatccttcggcatcaacagcatcaagctgcccaaggaccggatccacagcgagaagtccaacaagagcgtggccatggatatgctcaacgaagtgaagcggtgccccgacgagctgttcacaacactgtctgccgagaagcagtcccggttcagaatcatcagcgacgaccacaatgaagtgctgatgaagcggagcagcgacagattcgtgcctctgctgctgcagtatatcgattacggcaagctgttcgaccacatcaggttccacgtgaacatgggcaagctgagatacctgctgaaggccgacaagacctgcatcgacggccagaccagagtcagagtgatcgagcagcccctgaacggcttcggcagactggaagaggccgagacaatgcggaagcaagagaacggcaccttcggcaacagcggcatccggatcagagacttcgagaacatgaagcgggacgacgccaatcctgccaactatccctacatcgtggacacctacacacactacatcctggaaaacaacaaggtcgagatgtttatcaacgacaaagaggacagcgccccactgctgcccgtgatcgaggatgatagatacgtggtcaagacaatccccagctgccggatgagcaccctggaaattccagccatggccttccacatgtttctgttcggcagcaagaaaaccgagaagctgatcgtggacgtgcacaaccggtacaagagactgttccaggccatgcagaaagaagaagtgaccgccgagaatatcgccagcttcggaatcgccgagagcgacctgcctcagaagatcctggatctgatcagcggcaatgcccacggcaaggatgtggacgccttcatcagactgaccgtggacgacatgctgaccgacaccgagcggagaatcaagagattcaaggacgaccggaagtccattcggagcgccgacaacaagatgggaaagagaggcttcaagcagatctccacaggcaagctggccgacttcctggccaaggacatcgtgctgtttcagcccagcgtgaacgatggcgagaacaagatcaccggcctgaactaccggatcatgcagagcgccattgccgtgtacgatagcggcgacgattacgaggccaagcagcagttcaagctgatgttcgagaaggcccggctgatcggcaagggcacaacagagcctcatccatttctgtacaaggtgttcgcccgcagcatccccgccaatgccgtcgagttctacgagcgctacctgatcgagcggaagttctacctgaccggcctgtccaacgagatcaagaaaggcaacagagtggatgtgcccttcatccggcgggaccagaacaagtggaaaacacccgccatgaagaccctgggcagaatctacagcgaggatctgcccgtggaactgcccagacagatgttcgacaatgagatcaagtcccacctgaagtccctgccacagatggaaggcatcgacttcaacaatgccaacgtgacctatctgatcgccgagtacatgaagagagtgctggacgacgacttccagaccttctaccagtggaaccgcaactaccggtacatggacatgcttaagggcgagtacgacagaaagggctccctgcagcactgcttcaccagcgtggaagagagagaaggcctctggaaagagcgggcctccagaacagagcggtacagaaagcaggccagcaacaagatccgcagcaaccggcagatgagaaacgccagcagcgaagagatcgagacaatcctggataagcggctgagcaacagccggaacgagtaccagaaaagcgagaaagtgatccggcgctacagagtgcaggatgccctgctgtttctgctggccaaaaagaccctgaccgaactggccgatttcgacggcgagaggttcaaactgaaagaaatcatgcccgacgccgagaagggaatcctgagcgagatcatgcccatgagcttcaccttcgagaaaggcggcaagaagtacaccatcaccagcgagggcatgaagctgaagaactacggcgacttctttgtgctggctagcgacaagaggatcggcaacctgctggaactcgtgggcagcgacatcgtgtccaaagaggatggatcccttcaactgcctccacttgaaagactgacactgggatcccagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaggcaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtcaggggacgattccagtgcgctccaatgcgagcatccaaacgtgggacggggtgctgcaaggggagcggctgctcaccatgtcctgcagtgacaagattgcacgctggaacgtggtgggcatccagggatcactgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgtaa

SEQ ID NO: 11050 - RNA, 2862 nt, synthetic construct
  misc_feature 1..2862: note = Cas13b variant__Alistipes sp.__WP_047447901.1__Cas13b
  source 1..2862: mol_type = other RNA
atgagtaacgaaattggggcgtttcgggagcatcagtttgcctacgcacctggaaacgagaagcaggaggaggcaacctttgctacctactttaatctggctctttctaacgtagaggggatgatgtttggtgaagttgaatcgaatcccgataagattgaaaagagcctagatacattgccgcccgcaatattaaggcaaattgcctcattcatttggttgagcaaggaagatcaccccgataaggcatacagcacggaagaggtaaaggttattgtgacggatcttgttcgtaggctatgcttctataggaattacttctcgcattgcttctatttggacacgcaatacttttacagcgacgagcttgttgacaccacagctataggggagaaacttccctataactttcatcactttattaccaatcggctttttagatattctctgccagaaatcaccctttttaggtggaacgagggagaaaggaagtacgaaatacttcgcgatgggctgattttcttctgctgcctctttttaaaaaggggacaggccgagcgctttcttaacgagcttcgattttttaaacgaactgatgaggaagggcggataaagcgaaccatttttaccaaatactgcacccgtgagtctcacaagcacattggaatagaggagcaggactttttaatcttccaagatattattggcgacctaaaccgggtgcccaaagtgtgcgatggggttgtcgatttgagcaaagagaacgagaggtacatcaaaaatagggagacatccaacgaaagtgatgagaataaggctcgatataggctgcttattcgcgaaaaggataagtttccttactatctgatgcgttacatcgtcgattttggggtgctgccctgcattacctttaagcaaaacgactactctacaaaggagggacgaggacaattccactatcaggatgctgccgttgcccaagaggagcgatgctacaactttgtggttcggaatggcaacgtttactattcgtatatgccacaagcacaaaatgtggtgcgtattagcgagctgcagggaaccattagcgtggaggagttgcgcaatatggtgtatgcttcgattaatggtaaggatgtaaataaaagcgtagagcaatacctctaccatcttcatctgctttacgaaaaaatactgacaataagcgggcagactataaaggaagggcgggttgatgtagaggattaccgaccgctgctcgataagctgctgctaaggccagcttcgaatggcgaggagctaaggcgcgagctccgaaagctgctccccaaacgggtatgcgacttgcttagcaaccgctttgactgctcggaaggtgtttccgctgtagagaaacgcttaaaggcaatcttactacggcacgagcagctgctgctctcgcagaacccagctctgcatatcgataagataaaatcggttatagattacctgtacctctttttcagcgacgacgaaaagtttcgtcagcagcctaccgaaaaggctcatagagggctaaaggacgaggagtttcagatgtaccactaccttgttggcgactacgacagccatcctttggcgctgtggaaggagctggaggcaagtgggcggcttaagcccgaaatgagaaagctaacctctgccacctcgctgcatgggctttacatgctttgcctaaagggaacggtggagtggtgccgcaagcagctaatgagcataggaaaaggaacggccaaggtggaggctattgccgatagggtggggttaaagctctacgataagctaaaggagtatacccccgagcagctcgaaagggaggttaagcttgtggttatgcacggttatgccgctgccgctaccccaaaacccaaggcgcaggcggctattccctccaagctgacagagttgaggttctattcgtttctcggaaaaagagaaatgagctttgcagcatttataaggcaagataaaaaggcgcaaaagctttggcttaggaacttctatacggtagaaaatattaaaaccttacaaaaaagacaagctgcagctgatgcagcatgtaagaaactatataatttagtgggtgaggtagagcgggtgcacaccaacgataaggtgctggtgctggttgcccaacgctaccgcgagcggctgcttaatgttggttctaagtgcgcggtgacgcttgataatcccgaaaggcagcaaaagttggccgatgtgtacgaggtgcagaatgcctggctgtctattcgtttcgatgatttggattttacccttacccatgtcaacctctccaacctccgcaaggcctataaccttataccacggaagcatattttggcttttaaggagtatttggataaccgcgtaaagcaaaagctgtgcgaggagtgccgaaatgtaaggaggaaggaggatctctgcacttgttgcagcccccgctactctaatttaaccagctggctaaaggagaaccacagcgagtcgtcgatagagcgcgaagcggccaccatgatgctgctcgatgtggagcgcaagctgctaagcttcctactagacgagcgaaggaaggctattatcgagtacggaaagtttattccttttagtgcgttggtaaaggagtgccgtttggcagatgctggtttgtgcggtatccgcaacgatgtgctgcacgataacgtaatctcgtatgccgatgccataggtaagctaagtgcctacttcccgaaggaggccagcgaggccgtggagtatattaggcgtacaaaggaggtaagggagcaacgtagagaggagcttatggctaatagctcgcagtaa

SEQ ID NO: 11051 - RNA, 3348 nt, synthetic construct
  misc_feature 1..3348: note = Cas13b variant__Bacteroides pyogenes__ERI81700.1__Cas13b
  source 1..3348: mol_type = other RNA
atggaatcaatcaagaactcacagaaatcaaccggtaaaactttgcagaaggatccgccatatttcgggctatatcttaatatggcattgcttaatgtgcggaaagtagagaatcatattcgtaaatggttaggagatgtagctttgcttcccgagaaatcaggctttcattcacttttgacaactgataacttgtcttctgcaaagtggacgcgcttctattataaaagccggaaattccttccttttcttgaaatgttcgacagtgacaagaagagttatgaaaatcgtcgagaaacaacagaatgtcttgatactatagaccgacagaaaatatcttccctgttaaaagaggtctatgggaaactccaagatattcgtaatgcgttctctcattatcatatcgacgatcaatcagtgaagcatacagcactcatcatctcaagtgagatgcatcgttttattgaaaatgcttactcttttgctttgcagaagacccgcgctcgttttaccggagtttttgtagaaacagatttcttgcaagctgaagagaagggtgacaataaaaagttttttgccatcggtggtaatgaaggaataaaactgaaagacaacgctttgattttccttatatgtctttttcttgatagagaggaggctttcaagtttctcagccgtgcgaccggatttaaaagtaccaaagagaagggttttcttgctgtccgagagacgttttgcgctctctgttgccgccaaccgcacgaacgcctgcttagtgtcaatcccagagaagcgttgctgatggatatgctgaatgaactgaatcgctgccccgatatccttttcgagatgttggacgagaaggaccaaaagtcttttttgccgttgttgggagaagaagaacaagcacatatcttggaaaacagcctaaacgatgagctatgtgaagcgatcgatgatcctttcgagatgattgcttccttgagtaaaagggtgcgctacaaaaatcgctttccttatctgatgctcaggtatattgaagaaaagaatctactgccgttcattcgttttcgtatcgaccttggatgtttggaattggcctcatatcccaaaaagatgggagaggagaataactatgaacgtagcgtcacggatcacgctatggcattcggtcgtttgaccgatttccataatgaagatgcggttttacagcagataaccaaaggtataactgacgaagtgcgcttttctctgtatgcaccacgatacgcaatttataacaataagataggatttgtccggacaggtggtagtgataaaatttcttttccgacgctcaagaagaagggaggagaggggcattgtgtggcatatactctgcaaaatacgaaatcttttgggtttattagtatatatgatttgcggaaaatcttgctgctttcttttttagataaggataaggctaaaaacattgtttctggacttttggaacaatgtgaaaaacattggaaagatctaagtgagaatctgttcgatgcaattagaacagaactacaaaaggaatttcctgttcctttgattagatacaccctgcctcgaagtaaaggtggaaaacttgttagttcgaaattagcggataagcaggaaaagtatgaaagtgagttcgaaagacgtaaagaaaaactcactgaaatactctcggagaaagactttgatttatctcaaattcctcgccggatgattgatgaatggttgaatgttttgcctacttcaagagaaaagaaactaaaaggttatgtggaaacactgaagctggactgtcgggagcgtttgcgggttttcgaaaaacgggagaaaggtgagcatcctgtgccacctcgcattggcgaaatggctaccgatttagcgaaagatattatccgcatggttatcgaccaaggggtgaagcaacgcataacgtctgcttattattcggagatacagcgttgtctggcgcaatatgcgggcgacgataatcgacgtcatttggatagtataattcgagagttgaggcttaaagacacgaaaaatggtcatccttttcttgggaaagtgcttagacctggcttggggcatacggagaagttgtatcagcgatacttcgaagagaaaaaagagtggttggaagctactttttatccggcagcaagcccgaaaagagtgccgcgctttgtcaatcccccaactggaaaacaaaaagaactgcctttaattattcgtaatttgatgaaagaacggccggagtggagagattggaaacagaggaaaaacagccatccgatagatctcccttcacagcttttcgagaatgaaatttgtcgattgttgaaagataaaattgggaaggaaccttccggaaaactgaaatggaacgaaatgttcaagttgtattgggataaagaatttcccaatggcatgcagagattttatcgttgtaaaagaagagttgaagtattcgataaggtcgtagaatatgaatacagtgaagagggaggaaactataaaaagtattatgaggcattgatagatgaagttgtgaggcagaaaatctcttcttctaaggaaaagagcaaactccaagtagaagatttgactctttctgtgcgacgtgtgtttaagcgtgcaatcaacgaaaaggagtatcagcttcgattgctttgtgaggacgaccgcttgctgtttatggctgtaagagacttgtatgattggaaggaagcgcagcttgacttagataaaatagacaatatgctgggggaaccggtttctgtcagtcaagttattcaattggaaggcggacagcctgatgcagtgattaaagcagagtgtaagctcaaagacgtatctaagttgatgcgttattgttacgatgggcgggtaaagggattgatgccttattttgctaaccatgaagcaacacaagagcaagtggagatggaattgcgtcattacgaagatcatcgcaggcgtgtatttaattgggtctttgctttggaaaaatccgtattgaagaatgaaaagttgagaaggttctatgaagaatctcagggaggatgtgagcatcgcagatgcatagatgcgttgagaaaggcatcactcgtttcggaagaagaatatgagtttcttgtccatattcgtaataagtctgctcataatcaattccctgacttggaaattgggaagctgcccccgaacgttacatctggtttttgcgaatgtatatggagtaaatataaagcaataatttgtcgaatcattccttttatagatcccgaaagaagattttttgggaaacttttggagcagaaataa

SEQ ID NO: 11052 - RNA, 3348 nt, synthetic construct
  misc_feature 1..3348: note = Cas13b variant__Bacteroides pyogenes__WP_034542281.1__Cas13b
  source 1..3348: mol_type = other RNA
atggaatcaatcaagaactcacagaaatcaaccggtaaaactttgcagaaggatccgccatatttcgggctatatcttaatatggcattgcttaatgtgcggaaagtagagaatcatattcgtaaatggttaggagatgtagctttgcttcccgagaaatcaggctttcattcacttttgacaactgataacttgtcttctgcaaagtggacgcgcttctattataaaagccggaaattccttccttttcttgaaatgttcgacagtgacaagaagagttatgaaaatcgtcgagaaacagcagaatgtcttgatactatagaccgacagaaaatatcttccctgttaaaagaggtctatgggaaactccaagatattcgtaatgcgttctctcattatcatatcgacgatcaatcagtgaagcatacagcactcatcatctcaagtgagatgcatcgttttattgaaaatgcttactcttttgctttgcagaagacccgcgctcgttttaccggagtttttgtagaaacagatttcttgcaagctgaagagaagggtgacaataaaaagttttttgccatcggtggtaatgaaggaataaaactgaaagacaacgctttgattttccttatatgtctttttcttgatagagaggaggctttcaagtttctcagccgtgcgaccggatttaaaagtaccaaagagaagggttttcttgctgtccgagagacgttttgcgctctctgttgccgccaaccgcacgaacgcctgcttagtgtcaatcccagagaagcgttgctgatggatatgctgaatgaactgaatcgctgccccgatatccttttcgagatgttggacgagaaggaccaaaagtcttttttgccgttgttgggagaagaagaacaagcacatatcttggaaaacagcctaaacgatgagctatgtgaagcgatcgatgatcctttcgagatgattgcttccttgagtaaaagggtgcgctacaaaaatcgctttccttatctgatgctcaggtatattgaagaaaagaatctactgccgttcattcgttttcgtatcgaccttggatgtttggaattggcttcatatcccaaaaagatgggagaggagaataactatgaacgtagcgtcacggatcacgctatggcattcggtcgtttgaccgatttccataatgaagatgcggttttacagcagataaccaaaggtataactgacgaagtgcgcttttctctgtatgcaccacgatacgcaatttataacaataagataggatttgtccggacaagtggtagtgataaaatttcttttccgacgctcaagaagaagggaggagaggggcattgtgtggcatatactctgcaaaatacgaaatcttttgggtttattagtatatatgatttgcggaaaatcttgctgctttcttttttagataaggataaggctaaaaacattgtttctggacttttggaacaatgtgaaaaacattggaaagatctaagtgagaatctgttcgatgcaattcgaacagaactacaaaaggaatttcctgttcctttgataagatacaccctgcctcgaagtaaaggtggaaaacttgttagttcgaaattagcggataagcaggaaaagtatgaaagtgagttcgaaagacgtaaagaaaaactcactgaaatactctcggagaaagactttgatttatctcaaattcctcgccggatgattgatgaatggttgaatgttttgcctacttcaagagaaaagaaactaaaaggttatgtggaaacattgaagctggactgtcgggagcgtttgcgggttttcgaaaaacgggagaaaggtgaacatcctctgccacctcgcattggcgaaatggctaccgatttagcgaaagatattatccgcatggttatcgaccaaggggtgaagcaacgcataacgtctgcttattattcggagatacagcgttgtctggcacaatatgcgggcgacgataatcgacgtcatttggatagtataattcgagagttgaggcttaaagacacgaaaaatggtcatccttttcttgggaaagtgcttagacctggcttggggcatacggagaagttgtatcagcgatacttcgaagagaaaaaagagtggttggaagctactttttatccggcagcaagcccgaaaagagtgccgcgctttgtcaatcccccaactggaaaacaaaaagaactgcctttaattattcgtaatttgatgaaagaacggccggagtggagagattggaaacagaggaaaaacagccatccgatagatctcccttcacagcttttcgagaatgaaatttgtcgattgttgaaagataaaattgggaaggaaccttccggaaaactgaaatggaacgaaatgttcaagttgtattgggataaagaatttcccaatggcatgcagagattttatcgttgtaaaagaagagttgaagtattcgataaggtcgtagaatatgaatacagtgaagagggaggaaactataaaaagtattatgaggcattgatagatgaagttgtgaggcagaaaatctcttcttctaaggaaaagagcaaactccaagtagaagatttgactctttctgtgcgacgtgtgtttaagcgtgcaatcaacgaaaaggagtatcagcttcgattgctttgtgaggacgaccgcttgctgtttatggctgtaagagacttgtatgattggaaggaagcgcagcttgacttagataaaatagacaatatgctgggggaaccggtttctgtcagtcaagttattcaattggaaggcggacagcctgatgcagtgattaaagcagagtgtaagctcaaagacgtatctaagttgatgcgttattgttacgatgggcgggtaaagggattgatgccttattttgctaaccatgaagcaacacaagagcaagtggagatggaattgcgtcattacgaagatcatcgcaggcgtgtatttaattgggtctttgctttggaaaaatccgtattgaagaatgaaaagttgagaaggttctatgaagaatctcagggaggatgtgagcatcgcagatgcatagatgcgttgagaaaggcatcactcgtttcggaagaagaatatgagtttcttgtccatattcgtaataagtctgctcataatcaattccctgacttggaaattgggaagctgcccccgaacgttacatctggtttttgcgaatgtatatggagtaaatataaagcaataatttgtcgaatcattccttttatagatcccgaaagaagattttttgggaaacttttggagcagaaataa

SEQ ID NO: 11053 - RNA, 3675 nt, synthetic construct; identical to SEQ ID NO: 11044
  misc_feature 1..3675: note = Cas13b variant__Bergeyella zoohelcum__WP_002664492.1__Cas13b
  source 1..3675: mol_type = other RNA

SEQ ID NO: 11054 - RNA, 3600 nt, synthetic construct
  misc_feature 1..3600: note = Cas13b variant__Capnocytophaga canimorsus__WP_013997271.1__Cas13b
  source 1..3600: mol_type = other RNA
atgaaaaatatacagagattaggcaaaggaaatgagttttctccatttaaaaaagaagataaattctatttcggaggatttttaaatttagctaataataatattgaggatttctttaaggaaataatcactcgttttggcattgttattacagatgaaaataaaaaaccaaaagaaacttttggagagaaaattttgaatgaaatttttaaaaaagacatttctattgtagattacgaaaaatgggtaaatatattcgctgattattttccttttactaaatatttaagtttatatttagaagaaatgcagtttaaaaacagagtgatttgttttcgtgatgtaatgaaagaattgctaaaaactgtagaagctttacgaaatttttacacccactacgaccacgagccaattaaaattgaagatcgtgtgttttatttcttagataaagttttacttgatgtttctctcacagtaaaaaacaaatatctgaaaacagataagacaaaggagtttcttaatcaacatataggagaagaattaaaagagttatgcaagcaaagaaaagattatttagttggaaaagggaaacgaatcgataaagaaagcgaaattattaatggtatctataataacgcttttaaagattttatttgcaaaagagaaaaacaagacgataaagaaaatcataattccgtggagaagattctttgtaataaagaacctcaaaataagaaacaaaaatctagtgcaacggtgtgggaactttgttcaaaaagcagttcaaaatatactgagaaaagttttccaaatagagaaaatgacaaacattgcttagaagttcctatttcacaaaaaggaattgtatttcttctttcgttctttttgaataagggggaaatttatgctttaacttcaaatataaaagggttcaaggctaaaattactaaagaagaacctgttacatatgacaaaaacagtattcgttatatggcaacacatagaatgttttctttcttggcatataaaggattaaaaagaaaaattcgtacttctgagataaattataacgaagatggtcaagcttcaagtacttatgaaaaagaaactttgatgctacagatgctcgatgaattgaacaaagtacccgatgtggtctatcagaatttgagcgaagatgtacaaaaaactttcatcgaagattggaatgaatacctaaaagagaacaatggcgatgtagggacaatggaagaagagcaggtaattcatccagtgattcgcaagcgttacgaagataaattcaattattttgccattcgatttttagatgagtttgctcagttccctacgcttcgttttcaggtgcatttagggaattatctttgtgataaacgaacaaaacaaatatgcgataccaccacggaaagagaagtaaagaaaaagattaccgtgtttggaagactctcggaattggaaaataagaaagccatctttctaaacgagagagaagaaattaaaggatgggaagtttttcctaacccaagttatgattttcctaaggaaaatatttccgttaattataaagattttcctatcgtgggtagtattttggacagggaaaaacaacctgtttccaataaaataggtatcagagtaaagatagcagatgagttgcaaagagaaatagataaggctattaaagaaaaaaaactaagaaatccgaaaaatagaaaagcaaaccaagacgagaagcaaaaagaaaggttggttaatgaaatcgtaagtacaaacagtaacgaacaaggagaaccagtggtattcattgggcaacccacggcttatctgagtatgaatgatattcattcggttttgtatgaatttttaataaataagatatcaggagaagcattagaaacgaaaatcgtagaaaaaatagaaactcaaatcaagcagattataggaaaagatgccactactaaaattctaaaaccttataccaatgctaattctaactctatcaaccgagagaagttgttaagagaccttgagcaagaacaacaaattttaaaaacacttctcgaggagcagcaacagagagagaaagacaaaaaagacaaaaaatctaaacgaaaacacgaactttatccctctgaaaaaggaaaagtagcggtttggttggcgaatgacatcaagcgctttatgccaaaggcgtttaaggagcaatggcgtgggtaccatcatagcttgctgcaaaagtatttagcatattacgaacaaagtaaagaggaattgaaaaatcttttaccaaaagaagtatttaagcattttccttttaaattgaaggggtattttcagcaacaatatttgaatcaattctacactgattatttaaaaagacgattatcatatgtaaatgaattattactaaatattcaaaatttcaaaaatgataaagatgccttaaaagcaacagaaaaagagtgtttcaaattctttagaaaacaaaattatattattaatccgataaacattcaaattcagtcgatattggtatatccaatcttcttaaagagaggatttttagatgagaaaccaacaatgattgacagagaaaagtttaaagaaaataaagatactgaacttgcggattggtttatgcattataaaaattacaaagaagataattatcaaaaattttatgcgtatcctttagaaaaagtagaagagaaagagaaatttaaaagaaacaagcaaattaacaaacaaaaaaagaatgatgtttatacgctgatgatggtagaatacatcatacaaaagatattcggagacaaatttgttgaggagaatccgctggtattgaaggggatttttcaatcaaaagcagaacgacagcaaaacaatacacacgccgccactacacaagagcgaaatcttaatgggattttgaaccagccgaaggacatcaaaattcaaggtaaaataaccgtaaaaggtgtaaagctaaaagatattgggaatttcagaaaatatgagattgaccagcgtgtaaacacctttttggactacgagcctcgaaaagaatggatggcatatctgcctaatgactggaaagaaaaggaaaaacagggacagttgccccctaataatgttatagatagacaaataagtaaatatgaaaccgttagaagcaaaattttgctaaaagatgtacaagaattggagaaaataatttctgacgaaattaaggaagaacacagacacgatttgaagcaaggaaaatattataatttcaagtactatattctcaacggtcttttaagacagcttaaaaatgaaaatgtggagaattacaaggtatttaagttgaatactaatcctgaaaaagtgaatatcacccaactaaaacaagaagcaaccgatttagaacaaaaagcttttgttttaacctatattcgtaataaatttgcacacaaccaattgcctaaaaaagaattttgggactattgccaagaaaaatacggcaaaatagaaaaagaaaaaacctacgccgagtactttgctgaggtatttaaaagggaaaaagaagcactgataaagtaa

SEQ ID NO: 11055 - RNA, 3657 nt, synthetic construct
  misc_feature 1..3657: note = Cas13b variant__Capnocytophaga cynodegmi__WP_041989581.1__Cas13b
  source 1..3657: mol_type = other RNA
atggaaaataaaacatctttagggaataatatttattacaacccttttaaaccacaggataaatcttattttgcgggttatctcaatgcagcaatggaaaatatagatagtgtatttagagaattgggaaaaagattaaaaggcaaagaatacacttcagagaatttttttgatgctatctttaaggaaaacatttcattagtggaatacgaaaggtatgtgaaattgctttcggattatttccctatggctcgtcttttggataaaaaagaagttcctataaaagaacgaaaagaaaattttaaaaagaatttcagaggcattataaaagcggtaagagatttaagaaacttttatacgcataaggaacacggggaggtagaaattacagatgaaatatttggagtattggatgaaatgctgaaaagcacggttttaacggtgaaaaagaaaaaaataaaaaccgataaaacaaaagaaattctgaaaaaaagcatagaaaaacaattggatattttatgccaaaagaaattagaatatctaaaagacacagcaagaaaaatagaggagaagcgtagaaatcaaagagaaagaggagagaaaaaattggtgcctcgattcgaatacagtgacagaagggatgatttaatagcagcgatttataatgacgcttttgatgtttatatcgataagaaaaaagatagcctaaaagaatcgagtaaaacaaaatacaataccgaaagctaccctcaacaagaagaaggcgatttgaaaattccaatttcaaaaaacggagtggtcttcctgctttctttgtttctctccaaacaagaagtacacgcattcaaatctaaaatagcagggtttaaggcaaccgttatcgatgaagcaacggtgagccatagaaaaaacagcatttgttttatggctacgcacgaaattttctcgcatttggcttacaaaaaattgaagcgaaaagtaagaacggctgaaatcaactatagtgaggcagaaaatgctgaacagctttccatttacgccaaagaaactctaatgatgcagatgctcgatgaattgagcaaagtacccgatgtggtctatcaaaatttgagcgaagatgtacaaaaaactttcatcgaagattggaacgaatacctaaaagaaaacaatggcgatgtagggacaatggaagaagagcaggtaattcatccagtgattcgcaagcgttacgaagataaattcaattattttgccattcgatttttagatgagtttgctcagttccctacgcttcgttttcaggtgcatttagggaattatcttcatgattctcgccctaaggaacatctgatttccgaccgaagaataaaagaaaaaatcaccgttttcggcaggctttcggaattggagcataaaaaagcattgtttataaaaaacaccgaaaccaacgaagatagaaaacactattgggaagtttttcctaaccccaattatgattttcctaaggaaaatatttccgttaatgataaagattttcctatcgcgggtagtattttggacagagagaaacagcctaccgcagggaagatagggataaaagtgaatttgcttaaccaaaaatacatttcagaagtagataaagccgtaaaagcccatcagctcaagcaaagaaacaacaagccgtctatccagaacattatagaagaaatagtgccaatcaatggaagcaatccaaaagaaattattgttttcggtgggcaacccacggcttatctgagtatgaatgacattcattccattttgtatgagtttttcgataaatgggagaaaaagaaagaaaagttagaaaagaaaggtgaaaaagaattaagaaaggaaattggaaaagagttagaagagaaaatcgtaggaaaaattcaaactcaaattcagcaaatcatagataaagatatcaatgccaagatattaaaaccttatcaagacgatgattctactgctattgataaagagaaattgataaaagatttgaagcaggagcaaaagattttacaaaaattaaaaaacgaacaaacggctcgtgaaaaagaatatcaagaatgtattgcttatcaagaagaaagtcgaaaaataaaaagaagtgataaaagtcgtcaaaaatacttgagaaatcaacttaaacgaaagtatcctgaagttcctacacgaaaagaaattctttattatcaggaaaaagggaaagtagcggtttggttggcgaatgacatcaaacgctttatgcctaccgattttaaaaacgaatggaaaggggaacagcacagcttgttgcaaaaatcattggcgtactatgaacaatgtaaagaggagttgaaaaatcttttgccccaacaaaaagtatttaagcatttaccttttgagttggggggacattttcagcaaaaatatttgtaccaattttacactcgttatttagataaacgattggagcatatcagtgggctggtgcaacaagccgaaaactttaaaaacgaaaataaagtcttcaaaaaggtagaaaatgaatgttttaaattcttgaaaaaacaaaattatactcacaaaggcttagacgctcaagctcagtccgtattgggatatccgatttttttagaaagaggatttatggatgaaaaacctacgataattaaaggaaaaacttttaaaggaaacgaaagtctttttaccgattggttcagatattacaaggaatatcagaattttcagacattttatgatactgaaaattatccgcttgtagaattggaaaaaaaacaagcagaccgaaaacgagaaaccaaaatctaccaacaaaagaaaaacgatgtgtttacacttttgatggcgaaacatattttcaaatcggtattcaagcaggatagcatcgaccggttttcgttagaagacttgtatcagtctcgggaggaacgcctagaaaatcaggagaaagccaagcaaacgggtgagcgaaataccaactatatttggaacaaaaccgttgatttaaacttgtgtgacggaaaagttacggtagaaaatgtaaaactgaaaaatgtgggtaatttcataaaatatgaatacgaccaaagggttcaaactttcttaaaatatgaggaaaatataaaatggcaggcgtttctaatcaaagaaagtaaggaagaggaaaattatccgtacatagtggaaagagaaatagaacagtatgaaaaagtaagaagagaagaactgctgaaggaagtccaccttatagaggaatatattttagaaaaggtaaaagataaggaaatattaaaaaaaggggataatcaaaatttcaaatactacattctcaacggacttttaaagcaacttaaaaatgaagatgtggagagctataaggtattcaacttaaatactaaacctgaagatgtgaacattaaccaactaaaacaagaagcaaccgatttagaacaaaaagcctttgttttaacctatattcgtaataaatttgcacacaaccaattgcctaaaaaagaattttgggactattgccaagaaaaatatggcaaaatagaaaaagaaaaaacctatgccgagtactttgcagaagtatttaaaagggaaaaagaagcactgatgaagtaa

SEQ ID NO: 11056 - RNA, 3438 nt, synthetic construct
  misc_feature 1..3438: note = Cas13b variant__Chryseobacterium sp.__WP_047431796.1__Cas13b
  source 1..3438: mol_type = other RNA
atggaaacccaaacaatcggtcatggaattgcctatgatcattctaaaatacaagacaaacatttttttggaggattcttaaatttagctgagaataatattaaggctgtactaaaagctttttcagaaaaatttaatgttggtaatgttgatgtgaaacagttcgctgatgtctctctaaaggataatctccccgacaacgactttcaaaagagagtatcttttttaaaaatgtatttcccggttgttgattttatcaatatcccaaataatagagcaaagttcagatcagatcttactacactttttaaatcagtagatcaactaagaaatttttatacgcattattatcacaagcctttagattttgatgcttctctttttattcttttggatgatatttttgctagaacagctaaggaagtgagagaccagaagatgaaagatgataagaccagacaattgttaagtaaatccttatcagaagaactgcaaaaagggtatgagctgcagctggagagattaaaggaattgaatcgactagggaaaaaagttaacatacatgatcagctgggaattaaaaatggtgtccttaacaacgctttcaatcacttaatttataaagacggtgagtcttttaaaacaaagctcacttacagttcagcactgacctccttcgaatcggctgaaaacggtattgaaatctctcaaagcggccttttatttcttctcagtatgtttcttaagaggaaggaaattgaagatctaaaaaatagaaataaaggatttaaagctaaagtggtaatagatgaagatggaaaggtaaatggtcttaaatttatggctacccactgggttttttcctatctatgttttaaaggactcaaatcgaagttatccactgaatttcacgaagaaacattattaattcagattattgatgagctcagtaaagttccagatgagctttattgtgcgtttgataaagaaaccagagacaaatttatagaagatattaatgagtacgttaaggaaggacaccaggattttagtttggaagatgctaaagtcattcatcctgtcattcgtaaacgctatgaaaataagttcaactattttgctattcggtttctagatgaatttgtgaaattcccttcgctaaggtttcaggttcatgttggaaattatgtccatgacaggaggataaaaaatattgatggaacaacattcgagacggaaagggtagttaaggaccgtataaaagttttcggaagactttcagaaatctcttcttataaggctcaatatctcagttcggtttcagataaacatgatgaaactggatgggaaatatttcctaatccatcttatgtatttatcaataataacatacccattcatatttctgttgatacgagttttaaaaaagagattgccgattttaaaaaactgagaagagcccaagtgccggatgaattaaagataagaggtgctgagaaaaagagaaagtttgaaataacccaaatgatcggtagcaagtcagtgctaaaccaggaagaaccgatcgctcttctatccttaaacgaaattcccgctcttttatatgaaatattaataaatggcaaggagcctgcagaaattgaaagaataataaaagacaaactcaacgaaagacaggacgtcattaaaaattataatcctgaaaattggcttcctgcttctcagataagcagaaggctgcgaagcaataaaggagaaagaattataaatacagataaattacttcaattagtgacaaaagaattgcttgttacggagcaaaagctgaagataatctcggataacagggaagctcttaaacaaaagaaagagggtaaatatatcaggaagtttatatttacaaattctgagcttggaagggaagctatatggctcgccgatgatatcaaacgttttatgccggcagatgtacgaaaagaatggaaaggctaccagcatagccagttgcaacagtcattagctttctataactcacggcccaaagaagcattggcaattctagaaagtagttggaatctaaaagatgaaaagataatctggaatgaatggatattaaagagttttacacaaaacaaattttttgatgctttttataatgaatatttgaagggaagaaagaaatattttgcttttctatctgaacacattgttcagtatacttccaatgctaaaaatcttcaaaagtttataaagcaacagatgccaaaggacttattcgaaaagcgtcattatattatagaagatttacagacagagaaaaataaaattttgtccaaaccctttatttttccaagaggtatttttgataaaaaaccaacttttattaaaggtgtcaaggtcgaagatagcccggaatcctttgcaaactggtatcaatatggttatcaaaaagatcatcaatttcagaaattttatgattggaaacgtgattacagtgatgtttttttagaacatcttggaaaaccttttattaataatggtgataggagaactcttggtatggaggagttaaaagagcgtattattataaaacaggatcttaaaattaagaaaattaagatacaggatctgtttctaagacttatagctgagaatttgtttcaaaaagtctttaagtattccgcaaaacttcctttaagtgatttctacttaacccaggaagaaaggatggaaaaagaaaatatggccgctctacaaaatgtacgggaggaaggtgacaaaagcccaaacatcataaaagacaattttatatggagcaaaatgattccatataaaaaaggacagataattgagaatgctgttaagctaaaagacatcggaaagttaaatgttttatcattagatgataaagtgcagacgctcttatcttatgatgatgcaaaaccctggagtaagattgcattggaaaatgagttttctattggcgaaaattcttatgaggtaataagacgggaaaaactattcaaagaaattcagcaattcgaatctgaaattttatttcgatcagggtgggatggcattaatcatcccgctcaattggaagataacaggaacccaaagtttaagatgtatattgttaatggaattttaagaaaatctgcaggactatacagtcaaggtgaagatatttggtttgaatacaatgccgattttaataaccttgatgcagatgttttagaaactaagtctgaattggtacaattggcttttttagtgacagctattcgaaataaatttgctcacaatcaacttccggcaaaagaattttatttttatattagggctaaatatggatttgcagacgagccctctgtagcattagtttacctgaattttacaaagtatgcgattaatgaatttaaaaaggtgatgatatag

SEQ ID NO: 11057 - RNA, 3453 nt, synthetic construct
  misc_feature 1..3453: note = Cas13b variant__Flavobacterium branchiophilum__WP_014084666.1__Cas13b
  source 1..3453: mol_type = other RNA
atggaaaatttaaataaaatattagataaggaaaacgaaatttgtattagtaaaatatttaatactaaaggtattgctgcgcctattactgaaaaagctttagataatataaaaagtaaacaaaaaaacgatttgaataaagaagcaagattgcattatttttcaataggtcattcttttaagcagatagatacaaaaaaagtatttgattatgttttgattgaagaactcaaagatgaaaaaccattaaagttcataacactacaaaaagattttttcacaaaagaatttagcataaaacttcaaaaattaataaattctatcagaaatattaataaccattatgttcataattttaatgatataaatttaaacaagatagattctaatgtgtttcattttttaaaagaaagttttgaattagcaattattgagaaatattataaagtaaataaaaaatatccattagacaatgaaattgttttatttttaaaagaattatttattaaagatgaaaatacagcattgctaaattattttactaatttatcaaaagacgaagccattgaatatattttaacttttacaattactgaaaataaaatttggaatataaataatgaacacaacattttaaatattgaaaagggaaagtacttaacctttgaagcaatgctgtttctaataacaatcttcctttataaaaatgaagcgaatcatttattaccaaaattgtatgattttaaaaataacaaatcaaaacaagagttgtttacatttttttcaaagaaatttacaagtcaagatattgatgccgaagaaggtcatttaataaaatttagagatatgattcagtatttaaaccattatccgacagcatggaataacgatttaaaattggaatctgaaaataaaaacaaaataatgactacaaaactaatagatagcattatagaatttgaactaaatagtaactatccaagttttgcaacagatattcaatttaaaaaagaagcaaaagcgtttttatttgcttcaaacaaaaaaaggaatcaaacttcatttagtaataaatcatacaacgaagagattagacacaatccgcatataaaacaatacagagatgaaattgcaagcgctcttacgccaatttcttttaatgtaaaagaagataaatttaagatatttgtcaagaaacatgttttagaagagtatttccctaatagcattggatatgaaaagtttttagaatataacgacttcacagaaaaggaaaaagaagattttggtttaaaattatattcaaatccgaaaacaaataaattgattgaaagaatcgacaatcataaactagtaaagtcgcatggaaggaatcaagacagatttatggatttttccatgcgttttttagctgaaaacaattattttggtaaagatgcttttttcaaatgctacaaattttatgatactcaagaacaagatgaatttttgcaaagcaatgaaaacaatgatgatgtaaaatttcataaaggaaaagttactacttatattaaatatgaagagcatttaaaaaattactcctattgggattgtccatttgtagaagaaaacaattctatgagtgtaaaaataagtattggtagtgaagaaaagattttaaaaattcaacgaaacttaatgatttattttcttgaaaatgccttatacaatgaaaatgtagaaaatcaaggttataaattggtaaataattattaccgtgaattaaaaaaagatgttgaagaaagtatagcctctttagatttgataaaatccaatccagattttaaaagtaaatacaaaaaaattcttcccaaaagacttttacataattatgctcctgcaaaacaagataaagctccagaaaatgcttttgaaacattattaaaaaaagcagattttagagaagaacaatataaaaaactcttaaaaaaggcagaacatgaaaaaaacaaagaagactttgtaaaacgaaataaaggcaaacaatttaagttgcattttatacgaaaagcttgtcaaatgatgtattttaaagaaaaatacaatactctgaaagaaggtaatgctgcatttgaaaaaaaagacccagttattgaaaaaagaaaaaacaaagaacatgaatttggacatcataaaaatttaaacattacacgagaggagtttaatgattattgcaaatggatgtttgccttcaatggcaacgattcctataaaaaatatttaagggatttattttctgaaaaacatttttttgataaccaagagtataaaaacctatttgaaagttctgttaatttagaggctttttatgctaaaacaaaagaactatttaaaaaatggattgaaacaaataagccaacaaataatgaaaacagatatacacttgaaaactataaaaatttaatattacagaaacaagttttcatcaatgtatatcacttttcaaaatatttaattgataaaaatttattaaattcagaaaacaatgtgattcaatataaatcattagaaaatgtagaatacttaatctcggatttttattttcaaagtaaattatcaatagaccaatataaaacctgtggtaaattatttaacaagttaaaatcaaataaattagaagattgtttgctctatgaaattgcatacaattatattgacaaaaaaaacgttcataaaattgatattcaaaaaatactaacatcaaaaataattcttactataaatgatgctaatactccttataaaatatcggttccctttaataaattagagcgatatacagaaatgattgcaataaaaaatcaaaacaacctaaaagctcgatttttaatagatttgcctttatacctttcaaaaaataaaataaaaaaaggaaaagatagtgctggatatgaaataataattaagaatgatttagaaattgaagacattaatacaataaataataaaattataaatgatagtgtaaagtttacagaggtattgatggaactagaaaaatattttatattaaaggataaatgtattttatcaaaaaattatattgataatagtgagataccatcattaaaacaattttcaaaagtttggataaaagaaaatgaaaatgaaataattaactacaggaatatagcttgtcattttcatttacctttattagaaacttttgataatcttttattaaatgtggagcaaaaatttatcaaagaagaattgcaaaacgtttctactataaacgacttatcaaaacctcaggagtatttaattttattattcattaagtttaaacataataatttttacttgaatttatttaataaaaatgaaagtaaaacaataaaaaacgataaagaagtaaaaaaaaatagggttttgcaaaaatttataaaccaagttattttaaaaaaaaaataa

SEQ ID NO: 11058 - RNA, 3642 nt, synthetic construct
  misc_feature 1..3642: note = Cas13b variant__Flavobacterium columnare__WP_060381855.1__Cas13b
  source 1..3642: mol_type = other RNA
atgagttcaaaaaatgaatcttataacaaacaaaaaacttttaaccactacaaacaagaagacaaatacttttttggtggctttttgaataatgctgacgacaatttaagacaagttggcaaagagttcaaaacaaggattaattttaatcacaacaataatgaattagcaagtgtttttaaagattatttcaacaaagaaaaatcagttgccaaaagagagcatgcgttaaacttattaagtaattactttcctgttttagaacgaattcaaaagcatactaatcataactttgaacaaaccagagaaattttcgaattgttacttgatacaataaaaaaattaagagattattatacacatcattatcacaaacccatcactattaatcccaaagtctatgattttttagatgacaccttattagatgttttaattacaattaaaaaaaagaaagtaaaaaacgatacctctagagaactactaaaagaaaaatttagacctgaattaacacaattaaaaaatcaaaaaagagaagagttaattaaaaaaggcaaaaaactattagaagaaaatttagaaaatgcagttttcaatcactgtctaagaccttttttagaggaaaacaaaacagatgataaacaaaacaaaacagtttctttacgaaaatatagaaaatctaaaccaaacgaagaaacatcgattacgttgacccaaagtggattagtctttttaatctctttctttttacatcgaaaagagtttcaagttttcacatctggattagaaggatttaaggcaaaagtaaacactattaaggaagaagaaatctctttaaataaaaacaatattgtatacatgattacacattggtcgtattcatattacaattttaaaggtttaaaacatcgtataaaaacagaccaaggcgttagcacacttgaacaaaacaatactacacacagcttaacaaatactaatacaaaagaagctctactaactcaaatagtagactacttgagtaaagtaccaaatgaaatctacgaaactctttctgaaaaacaacagaaagagtttgaagaagacataaatgagtatatgcgtgagaatccagaaaatgaggactcaactttttcatcaatagtttctcacaaagtcattcgcaaacgctatgaaaataagttcaactattttgcaatgcgctttttagatgaatacgccgaactacctacattgcgatttatggtcaattttggcgactatattaaagatcgtcaaaagaaaatattggaatctatccaatttgattccgaaagaatcatcaaaaaagaaatccatctttttgaaaaactgggtctagttactgaatataaaaaaaacgtatacttaaaagaaacttccaatatagaccttagtcgttttcctttatttcctagtcccagttatgtaatggctaataacaatatacctttttatatagatagcagaagtaacaacttagatgaatatctaaaccaaaagaaaaaagcgcaaagtcaaaacagaaaaaggaatcttacttttgaaaagtataacaaagaacaatctaaagatgctattatagcaatgcttcaaaaagaaattggtgtaaaagatttacaacaaagaagtactatagggttattaagctgcaacgaactgcctagtatgctttatgaagtgattgttaaagatattaaaggagctgaacttgaaaacaaaattgctcaaaaaataagagaacaataccaaagtatcagagatttcacccttgatagtcctcaaaaagacaacataccaactacattaacaaaaacaataagcacagacacgtcagttacttttgaaaatcaacccatagatatccctcgtttaaaaaatgctcttcaaaaagaattaacgttaacacaagaaaaacttctaaatgttaagcaacatgaaattgaagtagacaattacaacagaaataagaatacatataaatttaagaatcagccaaaagataaagttgatgataataaactccaacgtaaatatgtattttatcgtaacgaaattggacaagaagctaattggttagccagcgaccttatccattttatgaaaaacaaatcgttatggaaagggtacatgcataacgaattacaatcatttttagccttttttgaagataaaaaaaatgactgtatagccttattagaaactgtttttaacctaaaagaagattgtattttaacaaaagacttaaaaaatttatttctcaagcatggtaattttattgatttctataaagaatatttaaaattaaaagaagacttcttgaatactgaatctacttttttagaaaatgggtttattgggttaccaccaaaaattttaaaaaaagaattatcaaaaaggctcaactatatattcattgtatttcaaaaacgccaatttataattaaagaattagaagaaaagaaaaacaatttatatgctgatgccatcaatttatcccgcggtatatttgacgagaaacctacaatgattccgtttaaaaaaccaaatccagatgagtttgcttcttggtttgtcgcatcttatcaatacaacaattatcaatctttttatgaattgacaccagacaaaatagagaatgataaaaagaaaaaatacaaaaacctacgagcgattaacaaagtaaaaattcaagactattatttaaaattaatggtagatactttgtatcaagacttgttcaatcagccattagacaaatccttatcagatttttatgtttccaaaacagatagagaaaaaataaaagccgatgccaaagcttaccaaaagcgcaacgatagcttcttatggaataaagtcatccatttatctttacaaaataataggattactgctaatccgaaactgaaagacataggaaaatacaagagagccctgcaagatgaaaaaatagccacgctacttacttatgatgatagaacgtggacgtatgccttacaaaaacctgagaaggaaaatgaaaacgattataaagaattgcactataccgcacttaatatggaattgcaagagtatgaaaaagtgcgtagtaaaaaactactaaaacaagtacaagaattagagaaacagattttagataaattttatgatttttctaataatgctactcatcctgaagatttagaaattgaggataaaaaaggaaaaagacaccctaattttaaactttacattacaaaagccttattaaaaaatgaatctgaaatcataaatttagaaaacatagatattgaaattttaattaaatattatgattataatactgaaaagttgaaggaaaaaataaaaaatatggatgaggatgaaaaagccaaaatagttaatactaaagagaattataacaaaataaccaatgttttaattaaaaaagcacttgttttaattatcattcgcaacaaaatggcgcacaatcaatatccacctaaatttatttacgatttagcgactcgttttgttccaaaaaaagaagaagaatactttgcttgctatttcaaccgagtttttgaaaccataacaacagaattatgggaaaacaaaaaaaaagctaaagaaatagtttaa

SEQ ID NO: 11059 - RNA, 3540 nt, synthetic construct
  misc_feature 1..3540: note = Cas13b variant__Flavobacterium columnare__WP_014165541.1__Cas13b
  source 1..3540: mol_type = other RNA
atgagttcaaaaaatgaatcttataacaaacaaaaaacttttaaccactacaaacaagaagacaaatacttttttggtggctttttgaataatgctgacgacaatttaagacaagttggcaaagagttcaaaacaaggattaattttaatcacaacaataatgaattagcaagtgtttttaaagattatttcaacaaagaaaaatcagttgccaaaagagagcatgcgttaaacttattaagtaattactttcctgttttagaacgaattcaaaagcatactaatcataactttgaacaaaccagagaaattttcgaattgttacttgatacaataaaaaaattaagagattattatacacatcattatcacaaacccatcactattaatcccaaaatatatgattttttagatgacaccttattagatgttttaattacaattaaaaaaaagaaagtaaaaaacgatacctctagagaactactaaaagaaaaacttagacctgaattaacacaattaaaaaatcaaaaaagagaagagttaattaaaaaaggcaaaaaactattagaagaaaatttagaaaatgcagttttcaatcactgtctaagaccttttttagaggaaaacaaaacagatgataaacaaaacaaaacagtttctttacgaaaatatagaaaatctaaaccaaacgaagaaacatcgattacgttgacccaaagtggattagtctttttaatgtccttctttttacatcgaaaagagtttcaagttttcacatctggattagaaggatttaaggcaaaagtaaacactattaaggaagaagaaatctctttaaataaaaacaatattgtatatatgattacacattggtcgtattcatattacaattttaaaggtttaaaacatcgcataaaaacagaccaaggcgttagcacccttgaacaaaacaatactacacacagcttaacaaatacaaatacaaaagaagccctactaactcaaatagtagactacttgagtaaagtaccaaatgaaatctacgaaaccctttctgaaaaacaacagaaagagtttgaagaagacataaatgagtatatgcgtgagaatccagaaaatgaggactcaactttttcatcaatagtttctcacaaagtcattcgcaaacgctatgaaaataagttcaactattttgcaatgcgctttttagatgaatacgccgaactacctacattgcgatttatggtcaattttggcgactatattaaagaccgtcaaaagaaaatattggaatctatccaatttgattccgaaagaatcatcaaaaaagaaatccatctttttgaaaaactgagtttagttactgaatataaaaaaaacgtatacttaaaagaaacttccaatatagaccttagtcgttttcctttatttcctaatcccagttacgtaatggctaataacaatatacctttttatatagatagcagaagtaacaacttagatgaatatctaaaccaaaagaaaaaagcgcaaagtcaaaacaaaaaaaggaatcttacttttgaaaagtataacaaagaacaatctaaagatgctattatagcaatgcttcaaaaagaaattggtgtaaaagatttacaacaacgaagtactattgggttattaagttgcaacgaactgcctagtatgctttatgaagtgattgttaaagatattaaaggagctgaacttgaaaataaaattgctcaaaaaataagagaacaataccaaagtattagagatttcacccttgatagtcctcaaaaagacaacataccaactacactaataaaaacaataaacacagactcgtcagttacttttgaaaatcaacccatagatatccctcgtttaaaaaatgccattcaaaaagaattaacgttaacacaagaaaaacttctaaatgttaaggaacatgaaattgaagtggacaactacaacagaaataagaatacatataaatttaagaatcagccaaaaaataaagttgatgataaaaaactccaacgtaaatatgtattttatcgtaacgaaattcgacaagaagctaattggttagccagcgaccttatccattttatgaaaaacaaatcgctatggaaaggatacatgcataacgaattacaatcatttttagccttttttgaagataaaaaaaatgactgtatagccttattagaaactgtttttaacctaaaagaagattgtattttaacaaaaggcttaaaaaatttatttctcaagcatggtaattttattgatttctacaaagaatatttaaaattaaaagaagacttcttgaatactgaatctacttttttagaaaatggtcttataggattacctccaaaaattttaaaaaaagaattatcaaaaaggttcaaatatatattcattgtatttcaaaaacgccaatttataattaaagaattagaagaaaagaaaaacaatttatatgctgatgccatcaatttatcccgtggtatatttgacgagaaacctacaatgattccgtttaaaaaaccaaatccagatgagtttgcttcttggtttgtcgcatcttatcaatacaacaattatcaatctttttatgaattgacaccagacattgtagagagagataaaaagaaaaaatacaaaaacctacgagctattaacaaagtaaaaattcaagactattatttaaaattaatggtagatactttgtatcaagacttgttcaatcagccattagacaaatccttatcagatttttatgtttctaaagcagaaagagaaaaaataaaagccgatgccaaagcttaccaaaagcgcaacgatagctccttatggaataaagtcatccatttatctttacaaaataataggattaccgctaatccgaaactaaaagacataggaaaatacaagagagccctgcaagatgaaaaaatagccacgctgcttacttatgatgatagaacgtggacgtatgccttacaaaaacctgagaaggaaaatgaaaacgattataaagaattgcactataccgcacttaatatggaattgcaagagtatgaaaaagtgcgtagtaaagaactactaaaacaagtacaagaattagagaagcaaattttagaagagtatactgattttttgagtacgcaaatacatccagccgattttgaaagagagggcaatccaaattttaaaaaatatttagcccattctattttagaaaacgaagatgatcttgataaactgccagaaaaagtagaagcaatgagggaactagatgaaaccattactaatccaatcattaaaaaagcgattgtgttaattatcattcgcaacaaaatggcgcacaatcaatatccacctaaatttatttacgatttagcgaatcgttttgtcccaaaaaaagaagaagaatactttgcgacctatttcaaccgagtttttgaaaccataacaaaagaattatgggaaaacaaagagaaaaaagataaaacacaggtctaa

SEQ ID NO: 11060 - RNA, 3642 nt, synthetic construct
  misc_feature 1..3642: note = Cas13b variant__Flavobacterium columnare__WP_063744070.1__Cas13b
  source 1..3642: mol_type = other RNA
atgagttcaaaaaatgaatcttataacaaacaaaaaacttttaaccactacaaacaagaagacaaatacttttttggtggctttttgaataatgctgacgacaatttaagacaagttggcaaagagttcaaaacaaggattaattttaatcacaacaataatgaattagcaagtgtttttaaagattatttcaacaaagaaaaatcagttgccaaaagagagcatgcgttaaacttattaagtaattactttcctgttttagaacgaattcaaaagcatactaatcataactttgaacaaaccagagaaattttcgaattgttacttgatacaataaaaaaattaagagattattatacacatcattatcacaaacccatcactattaatcctaaaatatatgattttttagatgacaccttattagatgttttaattacaattaaaaaaaagaaagtaaaaaacgatacctctagagaactactaaaagaaaaacttagacctgaattaacacaattaaaaaatcaaaaaagagaagagttaattaaaaaaggcaaaaaactattagaagaaaatttagaaaatgcagttttcaatcactgtctaagaccttttttagaggaaaacaaaacagatgataaacaaaacaaaacagtttctttacgaaaatatagaaaatctaaaccaaacgaagaaacatcgattacgttgacccaaagtggattagtctttttaatgtccttctttttacatcgaaaagagtttcaagttttcacatctggattagaaggatttaaggcaaaagtaaacactattaaggaagaaaaaatctctttaaataaaaacaatattgtatatatgattacacattggtcgtattcatattacaattttaaaggtttaaaacatcgtataaaaacagaccaaggcgttagcacccttgaacaaaacaatactacacacagcttaacaaatactaatacaaaagaagctctactaactcaaatagtagactacttgagtaaagtaccaaatgaaatctacgaaactctttctgaaaaacaacagaaagagtttgaagaagacataaatgagtatatgcgtgagaatccagaaaatgaggactcaactttttcatcaatagtttctcacaaagtcattcgcaaacgctatgaaaataagttcaactattttgcaatgcgctttttagatgaatacgccgaactacctacattgcgatttatggtcaattttggcgactatatcaaagatcgtcaaaagaaaatattggaatctatccaatttgattccgaaagaatcatcaaaaaagaaatccatctttttgaaaaactgggtctagttactgaatataaaaaaaacgtatacttaaaagaaacttccaatatagaccttagtcgttttcctttatttcctagtcccagttacgtaatggctaataacaatatacctttttatatagatagcagaagtaacaacttagatgaatatctaaaccaaaagaaaaaagcgcaaagtcaaaatagaaaaaggaatcttacttttgaaaagtataacaaagaacaatctaaagatgctattatagcaatgcttcaaaaagaaattggtgtaaaagatttacaacaaagaagtactattgggttattaagctgcaacgaactgcctagtatgctttatgaagtgattgttaaagatattaaaggagctgaacttgaaaataaaattgctcaaaaaataagagaacaataccaaagtattagagatttcacccttaatagtcctcaaaaagacaacataccaactacattaataaaaacaataagcacagacacgtcagttacttttgaaaatcaacccatagatatccctcgtttaaaaaatgccattcaaaaagaattagcgttaacacaagaaaaacttctaaatgttaagcaacatgaaattgaagtgaacaattacaacagaaataagaatacatataaatttaagaatcagccaaaagataaagttgatgataataaactccaacgtaaatatgtattttatcgtaacgaaattggacaagaagctaattggttagccagcgaccttatccattttatgaaaaacaaatcgttatggaaagggtacatgcataacgaattacaatcatttttagctttttttgaagataaaaaaaatgactgtatagccttattagaaactgtttttaacctaaaagaagattgtattttaacaaaagacttaaaaaatttatttctcaagcatggtaattttattgatttctataaagaatatttaaaattaaaagaagacttcttgaatactgaatctacttttttagaaaatgggtttattgggttaccaccaaaaattttaaaaaaagaattatcaaaaaggctcaactatatattcattgtatttcaaaaacgccaatttataattaaagaattagaagaaaagaaaaacaatttatatgctgatgccatcaatttatcccgcggtatatttgacgagaaacctacaatgattccgtttaaaaaaccaaatccagatgagtttgcttcttggtttgtcgcatcttatcaatacaacaattatcaatctttttatgaattgacaccagacaaaatagagaatgataaaaagaaaaaatacaaaaacctacgagcgattaacaaagtaaaaattcaagactattatttaaaattaatggtagatactttgtatcaagacttgttcaatcagccattagataaatccttatcagatttttatgtttccaaaacagatagagaaaaaataaaagccgatgccaaagcttaccaaaagcgcaacgatagcttcttatggaataaagtcatccatttatctttacaaaataataggattactgctaatccgaaactgaaagacataggaaaatacaagagagccctgcaagatgaaaaaatagccacgctacttacttatgatgatagaacgtggacgtatgccttacaaaaacctgagaaggaaaatgaaaacgattataaagaattgcactataccgcacttaatatggaattgcaagagtatgaaaaagtgcgtagtaaaaaactactaaaacaagtacaagaattagagaaacagattttagataaattttatgatttttctaataatgctactcatcctgaagatttagaaattgaggataaaaaaggaaaaagacaccctaattttaaactttacattacaaaagccttattaaaaaatgaatctgaaatcataaatttagaaaacatagatattgaaattttaattaaatattatgattataatactgaaaagttgaaggaaaaaataaaaaatatggatgaggatgaaaaagccaaaatagttaatactaaagagaattataacaaaataaccaatgttttaattaaaaaagcacttgttttaattatcattcgcaacaaaatggcgcacaatcaatatccacctaaatttatttacgatttagcgactcgttttgttccaaaaaaagaagaagaatactttgcttgctatttcaaccgagtttttgaaaccataacaacagaattatgggaaaacaaaaaaaaagctaaagaaatagtttaa

SEQ ID NO: 11061 - RNA, 3645 nt, synthetic construct
  misc_feature 1..3645: note = Cas13b variant__Flavobacterium columnare__WP_065213424.1__Cas13b
  source 1..3645: mol_type = other RNA
atgagttcaaaaaatgaatcttataacaaacaaaaaacttttaaccactacaaacaagaagacaaatacttttttggtggctttttgaataatgctgacgacaatttaagacaagttggcaaagagttcaaaacaaggattaattttaatcacaacaataatgaattagcaagtgtttttaaagattatttcaacaaagaaaaatcagttgccaaaagagagcatgcgttaaacttattaagtaattactttcctgttttagaacgaattcaaaagcatactaatcataactttgaacaaaccagagaaattttcgaattgttacttgatacaataaaaaaattaagagattattatacacatcattatcacaaacccatcactattaatcccaaaatatatgattttttagatgacaccttattagatgttttaattacaattaaaaaaaagaaagtaaaaaacgatacctctagagaactactaaaagaaaaacttagacctgaattaacacaattaaaaaatcaaaaaagagaagagttaattaaaaaaggcaaaaaactattagaagaaaatttagaaaatgcagttttcaatcactgtctaataccttttttagaggaaaacaaaacagatgataaacaaaacaaaacagtttctttacgaaaatatagaaaatctaaaccaaacgaagaaacatcgattacgttgacccaaagtggattagtctttttaatgtccttctttttacatcgaaaagagtttcaagttttcacatctggattagaaagatttaaggcaaaagtaaacactataaaggaagaagaaatctctttaaacaaaaacaatattgtatatatgattacacattggtcgtattcatattacaattttaaaggtttaaaacatcgtataaaaacagaccaaggcgttagcacccttgaacaaaacaatactacacacagcttaacaaatacaaatacaaaagaagccctactaactcaaatagtagactacttgagtaaagtaccaaatgaaatctacgaaaccctttctgaaaaacaacagaaagagtttgaagaagacataaatgagtatatgcgtgagaatccagaaaatgaggactcaactttttcatcaatagtttctcacaaagtcattcgcaaacgctatgaaaataagttcaactattttgcaatgcgctttttagatgaatacgccgaactacctacattgcgatttatggtcaattttggcgactatattaaagaccgtcaaaagaaaatattggaatctatccaatttgattccgaaagaatcatcaaaaaagaaatccatctttttgaaaaactgagtttagttactgaatataaaaaaaacgtatacttaaaagaaacttccaatatagaccttagtcgttttcctttatttcctaatcccagttacgtaatggctaataacaatatacctttttatatagatagcagaagtaacaacttagatgaatatctaaaccaaaagaaaaaagcgcaaagtcaaaacaaaaaaaggaatcttacttttgaaaagtataacaaagaacaatctaaagatgctattatagcaatgcttcaaaaagaaattggtgtaaaagatttacaacaacgaagtactattgggttattaagttgcaacgaactgcctagtatgctttatgaagtgattgttaaagatattaaaggagctgaacttgaaaataaaattgctcaaaaaataagagaacaataccaaagtattagagatttcacccttgatagtcctcaaaaagacaacataccaactacactaataaaaacaataaacacagactcgtcagttacttttgaaaatcaacccatagatatccctcgtttaaaaaatgctcttcaaaaagaattaacgttaacacaagaaaaacttctaaatgttaaggaacatgaaattgaagtggacaactacaacagaaataagaatacatataaatttaagaatcagccaaaaaataaagttgatgataaaaaactccaacgtaaatatgtattttatcgtaacgaaattcgacaagaagctaattggttagccagcgaccttatccattttatgaaaaacaaatcgctatggaaaggatacatgcataacgaattacaatcatttttagccttttttgaagataaaaaaaatgactgtatagccttattagaaactgtttttaacctaaaagaagattgtattttaacaaaaggcttaaaaaatttatttctcaagcatggtaattttattgatttctacaaagaatatttaaaattaaaagaagacttcttgagtactgaatctacttttttagaaaacgggtttattgggttaccacctaaaattttaaaaaaagaattatcaaaaaggctcaaatatatattcattgtatttcaaaaacgccaatttataattaaagaattagaagaaaagaaaaacaatttatatgctgatgccatcaatttatcccgtggtatatttgacgagaaacctacaatgattccgtttaaaaaaccaaatccagatgagtttgcttcttggtttgtcgcatcttatcaatacaacaattatcaatctttttatgaattgacaccagacattgtagagagagataaaaagaaaaaatacaaaaacctacgagcgattaacaaagtaaaaattcaagactattatttaaaattaatggtagatactttgtatcaagacttgttcaatcagccattagacaaatctttatcagatttttatgtttctaaagcagaaagagaaaaaataaaagccgatgccaaagcttaccaaaagctcaacgatagctccttatggaataaagtcatccatttatctttacaaaataataggattaccgctaatccgaaactaaaagacataggaaaatacaagagagccctgcaagatgaaaaaatagccacgctgcttacttatgatgctagaacgtggacgtatgccttacaaaaacctgagaaggaaaatgaaaacgattataaagaattgcactataccgcacttaatatggaattgcaagagtatgaaaaagtgcgtagtaaagaactactaaaacaagtacaagaattagagaaaaaaattttagataaattttatgatttttctaataatgctagtcatcctgaagatttagaaattgaggataaaaaaggaaaaagacaccctaattttaaactttacattacaaaagccttattaaaaaatgaatctgaaatcataaatttagaaaacatagatattgaaattttacttaaatattatgattataatactgaagagttgaaggaaaaaataaaaaatatggatgaggatgaaaaagccaaaataattaatactaaagagaattataacaaaataaccaatgttttaattaaaaaagcacttgttttaattatcattcgcaacaaaatggcgcacaatcaatatccacctaaatttatttacgatttagcgaatcgttttgtcccaaaaaaagaagaagaatactttgcgacctatttcaaccgagtttttgaaaccataacaaaagaattatgggaaaacaaagagaaaaaagataaaacacaggtctaa

SEQ ID NO: 11062 - RNA, 3468 nt, synthetic construct
  misc_feature 1..3468: note = Cas13b variant__Flavobacterium sp.__WP_045968377.1__Cas13b
  source 1..3468: mol_type = other RNA
atggataacaatattactgtagaaaaaacagaattaggtttaggtatcacctataatcatgataaagttgaagacaaacattatttcggtggtttctttaacttggctcaaaacaacattgatttagttgctcaagaatttaaaaaaagacttttaatacaaggaaaagatagtataaacatatttgctaattatttttctgaccaatgctcaattactaatctagaaagaggaattaaaatattagctgaatattttccagtggtttcttacattgacttagatgaaaaaaataaaagtaaaagtattagggagcatctaattttgttattagagacaatcaataatctaagaaattattacactcattattatcacaaaaaaataataattgatggttctttatttccactactcgatactatacttttaaaagtagttttagaaataaaaaagaagaaattaaaagaagacaaaaccaagcaattattaaaaaaaggacttgagaaagaaatgactatcctttttaatctaatgaaagctgagcaaaaagagaaaaaaattaaaggatggaacattgacgaaaatattaaaggtgcggttttgaatcgtgcttttagtcatctattatataatgatgaactaagtgattatagaaaatctaaatataatactgaggatgaaactttaaaagacacactaactgaaagtggtatcttatttttattatcctttttcttaaacaagaaagaacaagaacagttaaaagcaaatataaaaggttataaaggaaaaattgctagtattcctgatgaagagattacgttaaaaaacaatagtcttagaaatatggctacacactggacttattcacatcttacttataaaggattaaaacatcgaataaaaacggatcacgaaaaagaaacacttttagtaaacatggtggactatttaagtaaagttcctcatgaaatttaccaaaacctttcagaacaaaataaatctttatttcttgaagatataaatgaatatatgagagataatgaggaaaaccatgattcttctgaagcttctcgtgttattcacccagttattagaaaaaggtatgaaaacaagtttgcttattttgctattcgttttttagatgagtttgcagaatttcccacactacgatttatggttaacgtagggaattatattcacgataatcgaaaaaaagatattggaggaacttctttaataactaacagaacaataaagcaacaaatcaatgtttttggaaaccttacagaaattcataaaaagaaaaatgattattttgaaaaagaagaaaacaaagaaaaaacgttagaatgggaattatttccaaatcctagctatcattttcaaaaagaaaacattcctatttttatagatttagaaaaaagtaaagaaactaatgatttagctaaagaatatgcaaaagaaaaaaagaaaatatttggaagttcaagaaagaaacaacaaaatactgctaaaaaaaatagagaaacaattatcaatcttgtttttgacaaatacaaaacgagtgaccgtaaaacagtaacttttgaacaacccactgctttattaagtttcaatgaactaaattcttttttatatgcttttttagtagaaaataagactggtaaagaactcgaaaaaataattattgaaaaaatagcaaaccaatatcaaattctaaaaaattgttcttcaactgtcgataaaactaacgacaacataccaaagtctattaaaaaaatagttaatacaactacagattcattttatttcgagggcaaaaaaattgatattgaaaaactagaaaaagatatcactattgaaatagaaaaaacaaatgagaaattagaaacaataaaagaaaatgaagaatctgcacagaactataaaagaaatgaaagaaatactcaaaaaagaaaactatatcgaaaatatgtatttttcacaaacgaaataggaattgaagctacatggataaccaatgatattcttcgttttttagataataaagaaaactggaaaggataccaacatagtgaattacaaaaatttatttcacaatatgataattataagaaagaagctcttggattgctagaatcagaatggaatttagagtctgacgctttctttggacaaaatttaaaaagaatgtttcaaagcaattccaccttcgaaacgttctacaaaaaatatttagataatagaaaaaatactttagaaacttatttaagtgcaattgaaaatctaaaaacaatgacagatgtacgtcctaaagttctaaagaaaaagtggacagaactatttcgtttttttgacaagaaaatctatctattatctactattgagactaaaataaacgaacttattactaaacctatcaatttatcaagaggtatatttgaagagaaacctactttcataaatgggaaaaacccaaacaaagaaaataaccaacatctgtttgctaactggtttatttatgccaaaaaacaaactattcttcaagatttttacaatttacctttagaacagcctaaagcaattaccaaccttaaaaaacacaaatacaaattagaaagaagcataaacaatttaaaaattgaagatatttacatcaaacagatggttgattttttatatcaaaaactattcgaacaatcttttataggatctttacaggatctttatacttccaaagaaaaaagagaaattgaaaaaggcaaagccaaaaacgaacaaacacctgatgaaagttttatttggaaaaaacaagttgaaattaatactcacaatggaagaatcattgcaaaaacaaaaataaaagacattggaaagtttaaaaaccttttaactgacaataaaatagcacatttaatctcttatgatgatagaatatgggatttttcattaaacaacgatggtgatattacaaaaaaattatacagcataaataccgaattagaaagttatgaaacaattagaagagaaaagctactaaaacaaatacaacaatttgaacaatttcttttagagcaagaaactgagtatagtgcagaaagaaaacatcctgaaaagtttgaaaaagattgtaatcctaattttaaaaaatatataattgaaggagttttaaataaaattatacctaaccatgaaattgaagaaatcgaaattttaaaaagtaaagaagatgtatttaaaattaattttagtgatatactaatcctcaataatgacaatataaaaaaagggtatttactcattatgattagaaacaaatttgcacacaatcaattgattgacaaaaacttatttaacttttctttacaactgtattcaaaaaatgaaaacgaaaatttttcagaatatttaaacaaagtatgccaaaatatcattcaagagtttaaagaaaaactaaagtaa

SEQ ID NO: 11063 - RNA, 3480 nt, synthetic construct
  misc_feature 1..3480: note = Cas13b variant__Myroides odoratimimus__EHO06562.1__Cas13b
  source 1..3480: mol_type = other RNA
atgaaagatatacttactacagatacaacagaaaagcaaaaccgtttttattctcataaaatagcagataaatacttctttgggggatattttaatcttgcttctaataatatttatgaggtctttgaggaggtaaacaagagaaatacttttggtaaactagctaagcgagataatggtaatttaaagaattatattattcatgtttttaaagatgagttgagtattagtgattttgaaaaacgtgtggcaatattcgcaagttattttcctattttagaaacagtggataagaagagtattaaggaacgaaatagaaccatagaccttactctttctcaacgaataagacagtttagagagatgcttatctctttagtaactgcagttgaccagttgcgtaatttttacacacattatcaccacagtgatatagtgatagaaaataaggtattggacttcttaaatagttcattcgtgtcaacagcgctccatgtgaaagataaatatttaaaaacagataaaaccaaagagtttttaaaagagactattgcagctgaactagatattctgattgaggcgtataaaaagaagcagatagagaagaagaatactaggtttaaagctaataaaagagaggatattctcaatgcgatatataatgaggctttttggtcatttattaatgataaagataaagataaagataaagagacggtagtagcaaaaggtgcggatgcttattttgagaagaaccatcataaaagtaatgatcctgactttgctttaaatatctctgagaaaggtattgtatatctgttgtctttctttctgacaaataaagaaatggatagtctaaaggcaaatttgacaggctttaaaggaaaggttgatagagaaagtggtaatagcattaaatatatggctacacagcgtatctattcttttcatacttatagaggattaaaacaaaagatacgtacatcagaagaaggggtaaaagaaacgctactgatgcaaatgatagatgagctgagtaaagtgccgaatgttgtatatcaacatttatcaacaactcaacaaaatagttttatagaggactggaatgagtattataaagactatgaggatgacgtagaaacagatgatctgtcaagagtaattcacccagtgattcgcaagcgctatgaagacaggtttaactattttgctattcgtttcttagatgagttttttgatttccctacgttgagatttcaagtacatttaggagattatgtacacgatagaagaacgaaacagttagggaaagtagaatcagataggataatcaaggagaaggtaacagtatttgcacgcttaaaagatataaatagtgctaaagcgagttattttcactcgttagaagagcaggataaggaggagttagataataaatggactttattccctaacccgagttatgacttccctaaagagcatactcttcagcatcaaggtgaacaaaagaatgcaggaaagataggtatctatgtaaaacttagagatacccaatataaagagaaggcagctttagaagaagctaggaagtcattaaaccctaaagagaggtctgctactaaggctagtaaatatgatattattacacaaataatagaagcaaatgataatgtaaaaagcgaaaaacctttagtgttcactggtcaacctattgcatatctaagtatgaatgatatacattcaatgcttttctctttattaacagataatgcggagttaaagaaaactcctgaagaggtagaagcaaagctaatagaccaaataggtaaacagataaatgagattcttagtaaagatactgatactaaaatactaaaaaagtataaggacaacgacttaaaagagactgatacagataagataactagagatttagctcgtgataaagaggagatagagaagctaatcctagaacagaaacaaagagcagatgattataattatacatctagtacaaaatttaatattgataaaagtagaaaaaggaaacaccttttatttaatgctgaaaaaggaaagataggagtatggttggccaatgatattaaacgctttatgttcaaagaatctaagtctaaatggaagggatatcagcataccgaactacagaaactctttgcttattttgatacaagtaaaagtgatttggagttaattcttagtaatatggtgatggtcaaggattaccctattgagttaatagatttagtaaagaagtcacgaacattagttgattttctgaataagtatttagaagcaaggttagaatatatagagaatgtcatcacaagagtaaagaatagtataggaactccacagtttaaaacggttcgtaaagaatgttttactttcttaaaaaagtctaactacactgtagtttctttagataaacaagtagaacgcattctatctatgccactctttatagaacgtggttttatggatgataaacctacgatgttagaaggcaaaagctataaacaacataaggaaaagttcgcagattggttcgtacattataaagagaatagcaactatcagaacttctatgatacagaagtttatgagataacaacagaggataaaagagaaaaggctaaagtaacgaagaagataaagcaacagcagaagaatgatgtattcacactgatgatggtgaattatatgttagaagaagtattgaaattatcatctaacgaccgtttaagcttaaatgagctctatcaaactaaagaggagcgtatagtgaataaacaagtagctaaggatacacaggagcgtaataaaaactatatttggaacaaggtcgttgatctacagttgtgtgatggtttagtccatattgataatgtgaagctaaaagatataggcaactttagaaaatatgagaatgatagtcgtgtaaaagagtttcttacttatcagtcagacatagtctggagtgcttatttatcgaatgaggtagatagtaataagctctatgtaatagagcgtcagcttgataattatgaatctattagaagtaaagagctgttaaaagaggtacaagaaatagagtgtagcgtctataatcaagtagcgaataaagagtctttaaaacaatcaggtaatgagaactttaaacaatatgtacttcagggtttactgcctataggtatggatgtaagagagatgcttatattatcaactgacgtcaagtttaaaaaagaggagattatacagttaggacaagctggggaagtagagcaagatttgtatagtctaatctatatccgtaataagtttgctcacaaccaactgccgattaaggagttctttgatttctgtgaaaataattatagatcgattagtgataatgaatactatgctgagtattatatggagatattcagatctattaaagagaaatatgcaaactag

SEQ ID NO: 11064 - RNA, 3474 nt, synthetic construct
  misc_feature 1..3474: note = Cas13b variant__Myroides odoratimimus__WP_006261414.1__Cas13b
  source 1..3474: mol_type = other RNA
atgaaagatatacttactacagatacaacagaaaagcaaaaccgtttttattctcataaaatagcagataaatacttctttgggggatattttaatcttgcttctaataatatttatgaggtctttgaggaggtaaacaagagaaatacttttggtaaactagctaagcgagataatggtaatttaaagaattatattattcatgtttttaaagatgagttgagtattagtgattttgaaaaacgtgtggcaatattcgcaagttattttcctattttagaaacagtggataagaagagtattaaggaacgaaatagaaccatagaccttactctttctcaacgaataagacagtttagagagatgcttatctctttagtaactgcagttgaccagttgcgtaatttttacacacattatcaccacagtgagatagtgatagaaaataaggtattggacttcttaaatagttcattagtgtcaacagcgctccatgtgaaagataaatatttaaaaacagataaaaccaaagagtttttaaaagagactattgcagctgaactagatattctgattgaggcgtataaaaagaagcagatagagaagaagaatactaggtttaaagctaataaaagagaggatattctcaatgcgatatataatgaggctttttggtcatttattaatgataaagataaagataaagagacggtagtagcaaaaggtgcggatgcttattttgagaagaaccatcataaaagtaatgatcctgactttgctttaaatatctctgagaaaggtattgtatatctgttgtctttctttctgacaaataaagaaatggatagtctaaaggcaaatttgacaggctttaaaggaaaggttgatagagaaagtggtaatagcattaaatatatggctacacagcgtatctattcttttcatacttatagaggattaaaacaaaagatacgtacatcagaagaaggggtaaaagaaacgctactgatgcaaatgatagatgagctgagtaaagtgccgaatgttgtatatcaacatttatcaacaactcaacaaaatagttttatagaggactggaatgagtattataaagactatgaggatgacgtagaaacagatgatctgtcaagagtaattcacccagtgattcgcaagcgctatgaagacaggtttaactattttgctattcgtttcttagatgagttttttgatttccctacgttgagatttcaagtacatttaggagattatgtacacgatagaagaacgaaacagttagggaaagtagaatcagataggataatcaaggagaaggtaacagtatttgcacgcttaaaagatataaatagtgctaaagcgaattattttcactcgttagaagagcaggataaggaggagttagataataaatggactttattccctaacccgagttatgacttccctaaagagcatactcttcagcatcaaggtgaacaaaagaatgcaggaaagataggtatctatgtaaaacttagagatacccaatataaagagaaggcagctttagaagaagctaggaagtcattaaaccctaaagagaggtctgctactaaggctagtaaatatgatattattacacaaataatagaagcaaatgataatgtaaaaagcgaaaaacctttagtgttcactggtcaacctattgcatatctaagtatgaatgatatacattcaatgcttttctctttattaacagataatgcggagttaaagaaaactcctgaagaggtagaagcaaagctaatagaccaaataggtaaacagataaatgagattcttagtaaagatactgatactaaaatactaaagaagtataaggataacgacttaaaagagactgatacagataagataactagagatttagctcgtgataaagaggagatagagaagctaatcctagaacagaaacaaagagcagatgattataattatacatctagtacaaaatttaatattgataaaagtagaaaaaggaaacaccttttatttaatgctgaaaaaggaaagataggagtatggttggccaatgatattaaacgctttatgacagaggagtttaagtctaagtggaagggatatcagcatacagaactacagaaactctttgcttattatgatacaagtaaaagtgatttggatttaattcttagtgatatggtgatggtcaaggattaccctattgagttaatagctttagtaaagaagtcacgaacattagttgattttctgaataagtatttagaagcaaggttaggatatatggagaatgtcatcacaagagtaaagaatagtataggaaccccacagtttaaaacggttcgtaaagaatgttttactttcttaaaaaagtctaactacactgtagtttctttagataaacaagtagaacgcattctatctatgccactctttatagaacgtggttttatggatgataaacctacgatgttagaaggcaaaagctatcaacaacataaggaaaagttcgcagattggttcgtacattataaagagaatagcaactatcagaacttctatgatacagaagtttatgagataacaacagaggataaaagagaaaaggctaaagtaacgaagaagataaagcaacagcagaagaatgatgtattcacactgatgatggtgaattatatgttagaagaagtattgaaattatcatctaacgaccgtttaagcttaaatgagctctatcaaactaaagaggagcgtatagtgaataaacaagtagctaaggatacacaggagcgtaataaaaactatatttggaacaaggtcgttgaccttcaattatgcgaaggtttggttcgtatagataaggtgaaactaaaagatataggcaactttagaaaatatgagaatgatagtcgtgtaaaagagtttcttacttatcagtcagacatagtctggagtgcttatttatcgaatgaggtagatagtaataagctctatgtaatagagcgtcagcttgataattatgaatctattagaagtaaagagctgttaaaagaggtacaagaaatagagtgtagcgtctataatcaagtagcgaataaagagtctttaaaacaatcaggtaatgagaactttaaacaatatgtacttcagggtttagtgcctataggtatggatgtaagagagatgcttatattatcaactgacgttaagtttataaaagaggagattatacagttaggacaagctggggaagtagagcaagatttgtatagtctaatctatatccgtaataagtttgctcacaaccaactgccgattaaggagttctttgatttctgtgaaaataattatagatcgattagtgataatgaatactatgctgagtattatatggagatattcagatctattaaagagaaatatacaagttag

SEQ ID NO: 11065 - RNA, 3474 nt, synthetic construct
  misc_feature 1..3474: note = Cas13b variant__Myroides odoratimimus__EKB06014.1__Cas13b
  source 1..3474: mol_type = other RNA
atgaaagatatacttactacagatacaacagaaaagcaaaaccgtttttattctcataaaatagcagataaatacttctttgggggatattttaatcttgcttctaataatatttatgaggtctttgaggaggtaaacaagagaaatacttttggtaaactagctaagcgagataatggtaatttaaagaattatattattcatgtttttaaagatgagttgagtattagtgattttgaaaaacgtgtggcaatattcgcaagttattttcctattttagaaacagtggataagaagagtattaaggaacgaaatagaaccatagaccttactctttctcaacgaataagacagtttagagagatgcttatctctttagtaactgcagttgaccagttgcgtaatttttacacacattatcaccacagtgagatagtgatagaaaataaggtattggacttcttaaatagttcattagtgtcaacagcgctccatgtgaaagataaatatttaaaaacagataaaaccaaagagtttttaaaagagactattgcagctgaactagatattctgattgaggcgtataaaaagaagcagatagagaagaagaatactaggtttaaagctaataaaagagaggatattctcaatgcgatatataatgaggctttttggtcatttattaatgataaagataaagataaagagacggtagtagcaaaaggtgcggatgcttattttgagaagaaccatcataaaagtaatgatcctgactttgctttaaatatctctgagaaaggtattgtatatctgttgtctttctttctgacaaataaagaaatggatagtctaaaggcaaatttgacaggctttaaaggaaaggttgatagagaaagtggtaatagcattaaatatatggctacacagcgtatctattcttttcatacttatagaggattaaaacaaaagatacgtacatcagaagaaggggtaaaagaaacgctactgatgcaaatgatagatgagctgagtaaagtgccgaatgttgtatatcaacatttatcaacaactcaacaaaatagttttatagaggactggaatgagtattataaagactatgaggatgacgtagaaacagatgatctgtcaagagtaattcacccagtgattcgcaagcgctatgaagacaggtttaactattttgctattcgtttcttagatgagttttttgatttccctacgttgagatttcaagtacatttaggagattatgtacacgatagaagaacgaaacagttagggaaagtagaatcagataggataatcaaggagaaggtaacagtatttgcacgcttaaaagatataaatagtgctaaagcgagttattttcactcgttagaagagcaggataaggaggagttagataataaatggactttattccctaacccgagttatgacttccctaaagagcatactcttcagcatcaaggtgaacaaaagaatgcaggaaagataggtatctatgtaaaacttagagatacccaatataaagagaaggcagctttagaagaagctaggaagtcattaaaccctaaagagaggtctgctactaaggctagtaaatatgatattattacacaaataatagaagcaaatgataatgtaaaaagcgaaaaacctttagtgttcactggtcaacctattgcatatctaagtatgaatgatattcattcaatgcttttctctttattaacagataatgcggagttaaagaaaactcctgaagaggtagaagcaaagctaatagaccaaataggtaaacagataaatgagattcttagtaaagatactgatactaaaatactaaagaagtataaggataacgacttaaaagagactgatacagataagataactagagatttagctcgtgataaagaggagatagagaagctaatcctagaacagaaacaaagagcagatgattataattatacatctagtacaaaatttaatattgataaaagtagaaaaaggaaacaccttttatttaatgctgaaaaaggaaagataggagtatggttagccaatgatattaaacgctttatgttcaaagaatctaagtctaaatggaagggatatcaacatacagaactacagaaactctttgcttattttgatacaagtaaaagtgatttggagttaattctaagtgatatggtgatggtcaaggactatccaatagagttaatagatttagttcggaagtcaagaacattagttgattttctgaataagtatttagaagcaaggttaggatatatagagaatgtcatcacaagagtaaagaatagtatagggacaccacagtttaaaacggttcgtaaagagtgttttgctttcttaaaagagtctaactacactgtagcttctttagataaacagatagagcgcatcctatctatgcctctctttatagaacgtggttttatggatagcaaacctacgatgttagaaggcaaaagctatcaacagcataaggaagactttgctgattggttcgtacattataaagagaatagcaactatcagaacttctatgatacagaagtttatgagataataacagaggataaaagagaacaagctaaagtaacgaagaaaataaagcaacagcagaagaatgatgtattcacactgatgatggtgaattatatgctagaagaagtattgaaattaccatctaacgatcgtttaagcttaaatgagctctatcaaactaaagaggagcgtatagtgaataaacaagtagctaaggatacgcaggagcgtaataaaaactatatttggaacaaggtcgttgaccttcaattatgcgaaggtttggttcgtatagataaggtgaaactaaaagatataggcaactttagaaaatatgagaatgatagtcgtgtaaaagagtttcttacttatcagtcagacatagtctggagtggttatttatcgaatgaggtagatagtaataagctctatgtaatagagcgtcagcttgataattatgaatctattagaagtaaagagctgttaaaagaggtacaagaaatagagtgcatcgtctataatcaagtagcaaataaggagtctttaaaacaatcaggtaatgagaactttaaacaatatgtacttcaggggttactgcctcgaggtacggatgtaagagagatgcttatattatcaactgacgtcaagtttaaaaaagaggagattatgcagttaggacaagttagggaagtagaacaagatttgtatagtctaatctatatccgcaataagtttgcgcataatcaactgccgattaaggagttctttgatttctgtgaaaataattatagaccgattagtgataatgaatactatgctgagtattatatggagatattcagatctattaaagagaaatatgcaagctag

SEQ ID NO: 11066 - RNA, 3480 nt, synthetic construct
  misc_feature 1..3480: note = Cas13b variant__Myroides odoratimimus__WP_058700060.1__Cas13b
  source 1..3480: mol_type = other RNA
atgaaagatatacttactacagatacaacagaaaagcaaaaccgtttttattctcataaaatagcagataaatacttctttgggggatattttaatcttgcttctaataatatttatgaggtctttgaggaggtaaacaagagaaatacttttggtaaactagctaagcgagataatggtaatttaaagaattatattattcatgtttttaaagatgagttgagtattagtgattttgaaaaacgtgtggcaatattcgcaagttattttcctattttagaaacagtggataagaagagtattaaggaacgaaatagaaccatagaccttactctttctcaacgaataagacagtttagagagatgcttatctctttagtaactgcagttgaccagttgcgtaatttttacacacattatcaccacagtgatatagtgatagaaaataaggtattggacttcttaaatagttcattcgtgtcaacagcgctccatgtgaaagataaatatttaaaaacagataaaaccaaagagtttttaaaagagactattgcagctgaactagatattctgattgaggcgtataaaaagaagcagatagagaagaagaatactaggtttaaagctaataaaagagaggatattctcaatgcgatatataatgaggctttttggtcatttattaatgataaagataaagataaagataaagagacggtagtagcaaaaggtgcggatgcttattttgagaagaaccatcataaaagtaatgatcctgactttgctttaaatatctctgagaaaggtattgtatatctgttgtctttctttctgacaaataaagaaatggatagtctaaaggcaaatttgacaggctttaaaggaaaggttgatagagaaagtggtaatagcattaaatatatggctacacagcgtatctattcttttcatacttatagaggattaaaacaaaagatacgtacatcagaagaaggggtaaaagaaacgctactgatgcaaatgatagatgagctgagtaaagtgccgaatgttgtatatcaacatttatcaacaactcaacaaaatagttttatagaggactggaatgagtattataaagactatgaggatgacgtagaaacagatgatctgtcaagagtaactcacccagtgattcgcaagcgctatgaagacaggtttaactattttgctattcgtttcttagatgagttttttgatttccctacgttgagatttcaagtacatttaggagattatgtacacgatagaagaacgaaacagttagggaaagtagaatcagataggataatcaaggagaaggtaacagtatttgcacgcttaaaagatataaatagtgctaaagcgagttattttcactcgttagaagagcaggataaggaggagttagataataaatggactttattccctaacccgagttatgacttccctaaagagcatactcttcagcatcaaggtgaacaaaagaatgcaggaaagataggtatctatgtaaaacttagagatacccaatataaagagaaggcagctttagaagaagctaggaagtcattaaaccctaaagagaggtctgctactaaggctagtaaatatgatattattacacaaataatagaagcaaatgataatgtaaaaagcgaaaaacctttagtgttcactggtcaacctattgcatatctaagtatgaatgatatacattcaatgcttttctctttattaacagataatgcggagttaaagaaaactcctgaagaggtagaagcaaagctaatagaccaaataggtaaacagataaatgagattcttagtaaagatactgatactaaaatactaaaaaagtataaggacaacgacttaaaagagactgatacagataagataactagagatttagctcgtgataaagaggagatagagaagctaatcctagaacagaaacaaagagcagatgattataattatacatctagtacaaaatttaatattgataaaagtagaaaaaggaaacaccttttatttaatgctgaaaaaggaaagataggagtatggttggccaatgatattaaacgctttatgttcaaagaatctaagtctaaatggaagggatatcagcatatcgaactacagaaactctttgcttattttgatacaagtaaaagtgatttggagttaattcttagtaatatggtgatggtcaaggattaccctattgagttaatagatttagtaaagaagtcacgaacattagttgattttctgaataagtatttagaagcaaggttagaatatatagagaatgtcatcacaagagtaaagaatagtataggaactccacagtttaaaacggttcgtaaagaatgttttactttcttaaaaaagtctaactacactgtagtttctttagataaacaagtagaacgcattctatctatgccactctttatagaacgtggttttatggatgataaacctacgatgttagaaggcaaaagctataaacaacataaggaaaagttcgcagattggttcgtacattataaagagaatagcaactatcagaacttctatgatacagaagtttatgagataacaacagaggataaaagagaaaaggctaaagtaacgaagaagataaagcaacagcagaagaatgatgtattcacactgatgatggtgaattatatgttagaagaagtattgaaattatcatctaacgaccgtttaagcttaaatgagctctatcaaactaaagaggagcgtatagtgaataaacaagtagctaaggatacacaggagcgtaataaaaactatatttggaacaaggtcgttgatctacagttgtgtgatggtttagtccatattgataatgtgaagctaaaagatataggcaactttagaaaatatgagaatgatagtcgtgtaaaagagtttcttacttatcagtcagacatagtctggagtgcttatttatcgaatgaggtagatagtaataagctctatgtaatagagcgtcagcttgataattatgaatctattagaagtaaagagctgttaaaagaggtacaagaaatagagtgtagcgtctataatcaagtagcgaataaagagtctttaaaacaatcaggtaatgagaactttaaacaatatgtacttcagggtttactgcctataggtatggatgtaagagagatgcttatattatcaactgacgtcaagtttaaaaaagaggagattatacagttaggacaagctggggaagtagagcaagatttgtatagtctaatctatatccgtaataagtttgctcacaaccaactgccgattaaggagttctttgatttctgtgaaaataattatagatcgattagtgataatgaatactatgctgagtattatatggagatattcagatctattaaagagaaatatgcaaactag

SEQ ID NO: 11067 - RNA, 3465 nt, synthetic construct
  misc_feature 1..3465: note = Cas13b variant__Paludibacter propionicigenes__WP_013446107.1__Cas13b
  source 1..3465: mol_type = other RNA
atgaaaacatctgcaaacaacatttatttcaatggaatcaattcttttaaaaagattttcgactccaagggagctattgcaccaatagcagaaaagtcatgtcgcaacttcgacatcaaagcacaaaacgatgtaaacaaagaacaacgtattcattattttgccgttgggcatacatttaaacaactggataccgagaatctgtttgaatacgtcctcgatgaaaatttacgagcaaaaagaccaacacgttttataagcctacaacagtttgataaagaatttatagaaaatattaaacgtttaatatcggacatccgcaatatcaatagtcactatatccatcgtttcgaccctttaaagattgatgctgttcccaccaacataatcgattttctgaaagagagctttgagctggctgtaatacaaatctacctgaaagaaaaaggaataaactatcttcaatttagtgagaacccacatgccgatcaaaaactggttgcgtttctgcacgacaagtttttgcctctggacgaaaagaagacttcaatgcttcagaatgaaacccctcaattaaaagaatacaaggaataccgaaagtattttaaaacattatcgaaacaagctgctatagaccaacttctgtttgcagaaaaagagaccgactatatctggaatctatttgatagtcatccggtactcactataagtgctggtaaatacctatctttttattcatgcttgtttttgctttccatgtttttatacaagagcgaagcaaaccagcttatatccaagataaaagggtttaaaaagaatacaaccgaagaggagaaaagtaagcgggagatatttacttttttctccaaaagattcaacagcatggatattgatagcgaagaaaatcaactggtaaagttcagggatttgatattatatctgaatcattatccggtggcatggaataaagaccttgaactggattcgtcgaaccctgccatgaccgacaagctcaagagtaaaattattgaactggaaataaatcgttcatttcctttatacgaaggaaatgagcggttcgccacatttgccaaatatcagatttggggtaagaagcatctgggcaagtccatcgaaaaagaatatataaatgcaagctttaccgacgaagaaataactgcttatacgtacgaaacagacacctgccccgagttgaaagatgctcataaaaaattggctgacttaaaagccgcaaaggggctattcgggaagagaaaggagaaaaacgaaagtgatattaaaaaaacggaaacgagcattagggaattacaacatgagccaaatccgataaaagacaagttgattcagcgtattgaaaagaacctgctcaccgtttcttatggacgaaaccaggatcggtttatggacttttcagcgcgctttttggctgaaatcaattacttcgggcaagatgcctcgtttaaaatgtatcatttttacgctaccgatgagcaaaacagcgaacttgaaaaatatgaactacccaaagataaaaagaaatacgacagcctgaaatttcatcaagggaagcttgtccactttatcagctataaagaacatcttaaacgttacgaatcgtgggatgacgcttttgttatcgagaataatgccattcagcttaaactttcgtttgatggagttgaaaacacagttaccattcagcgggcattattgatttatttgttggaagatgcactcagaaacattcaaaacaatacggctgaaaatgcaggaaaacaactattacaagaatattactcgcacaacaaagccgacctcagcgcattcaaacaaattctgacacaacaagacagcattgagccacaacaaaaaacagaatttaaaaagcttctacccagaagactattaaataattattcaccagcaataaatcatttacaaaccccacattcatcactacctctcatacttgaaaaggctttactggcagaaaaacgatactgctcactggtagtgaaagcaaaagctgaaggcaattacgatgatttcataaagcggaacaaaggcaaacaatttaagctccagtttatacgaaaagcctggaatttgatgtattttagaaacagctatttgcagaacgtacaggcagcagggcaccacaaaagctttcacattgagcgcgatgagttcaatgatttctcgcgatatatgtttgccttcgaagagctaagtcaatacaaatactacttaaacgagatgtttgaaaagaaaggattctttgagaataatgagtttaagatactgttccaaagcggaacttcgttggaaaacctatacgaaaaaactaaacaaaagtttgaaatatggctcgcaagtaataccgcaaagacgaataagcctgacaactatcacctgaataactatgaacaacagttcagcaaccaactgtttttcatcaacctttcgcatttcatcaattatttgaaatcaacaggcaaactacaaactgatgctaacgggcaaataatatacgaggctttaaacaacgttcaataccttattccggagtattactataccgacaaaccagagcgcagcgaatctaaaagcggaaataagctttacaataaattaaaagccaccaaactggaagatgcattgctttacgaaatggctatgtgctatctgaaagcagacaaacagattgccgacaaagcaaaacaccccatcaccaaactgctaacaagcgatgtggagtttaatatcaccaacaaagaaggaatccagctctatcatttattggtgccatttaaaaaaatcgatgcctttatcggcttaaaaatgcacaaagaacaacaagacaaaaaacacccaactagttttcttgccaatattgtcaactacctggaattggtaaagaatgacaaagacatcagaaaaacctatgaagcctttagtacgaatcctgtgaagaggacattaacctacgacgatctggcgaagatagacggtcacttgatttccaaatctatcaagttcaccaatgtaacattggagttggaacgctattttatttttaaagaatcattaatcgtcaaaaagggcaacaatattgatttcaagtatatcaaaggcttaagaaattattacaacaatgaaaagaaaaagaacgaaggaatcagaaataaggcattccatttcggtatccccgattcgaagagttatgaccaactgatacgtgatgctgaagttatgtttatagccaacgaggtgaaaccgactcatgccacaaaatataccgatctgaacaaacaattacacaccgtatgcgataaattgatggagacagttcacaacgattattttagcaaagaaggtgatggaaaaaagaaacgtgaagctgccgggcaaaagtattttgaaaatataatctctgctaagtaa

SEQ ID NO: 11068 - RNA, 3396 nt, synthetic construct
  misc_feature 1..3396: note = Cas13b variant__Phaeodactylibacter xiamenensis__WP_044218239.1__Cas13b
  source 1..3396: mol_type = other RNA
atgacaaatacgccgaaacgccgaacgcttcacagacacccatcctactttggggcctttctgaatatcgcacgtcacaatgcatttatgatcatggagcatttgtctaccaaatatgatatggaggacaaaaacaccctggatgaagctcagctcccaaatgccaaactatttggctgcctgaagaaaagatatggcaagccagatgttacagaaggtgtctcgcgcgacttaagaagatacttcccattccttaattaccctctattcctacacctagaaaagcagcaaaacgcggaacaggctgctacctatgacatcaatcctgaagatatagagtttacgcttaaaggctttttcaggttgctcaaccaaatgcgtaacaactactcgcattacatttctaacacagactacggtaagtttgacaagctccccgtacaagatatttacgaagccgctattttcaggctcctcgataggggaaaacacactaaaaggtttgacgtctttgaaagtaagcatacaaggcaccttgaaagcaacaatagtgagtataggcccagaagccttgcaaactctccagatcatgaaaacacggttgcttttgtcacctgtctcttcctggaacgcaaatacgcctttccttttctgagcagactggattgttttagaagtactaatgatgcagcagaaggagatcccctaatccggaaagcaagccatgagtgctatactatgttttgttgccggcttccacaaccgaaactggaaagcagtgatattctgctagacatggtcaatgaacttgggcggtgcccgagtgctttgtacaacttgttgtcagaagaagatcaagcacgctttcacatcaagcgagaggagataaccggttttgaagaagaccctgacgaagagctcgaacaagagattgtattaaaacggcacagtgaccgtttcccttactttgcacttcgctattttgatgatacagaggcttttcaaaccttacggtttgatgtatacctgggcaggtggaggaccaaaccggtttataagaaacggatctatggtcaagagcgggatagagtgcttacccaatctatccgaacctttacaagactaagccggcttcttcctatctacgaaaacgtaaagcatgatgctgtccgacagaatgaagaggatggcaaattggtaaaccccgatgtaacatcccagtttcacaaaagctggatccaaatagaaagtgatgatcgtgctttcctctcagacagaattgagcacttttcgcctcattataatttcggagatcaggtcatcggtttgaagtttatcaatcctgatcggtatgccgctattcaaaatgtatttccaaagctaccaggagaggagaagaaagataaagatgcaaaactcgttaatgaaacagcagatgcaataattagcacccatgagatccgtagcttgtttttataccactacctaagtaaaaagcctatttcagcaggggacgagagaaggtttattcaggtagatacggagacttttataaagcagtatatagatacgatcaaactgttttttgaagatatcaaatcaggcgaactacaacctattgccgatccgcccaactaccaaaagaatgaacccttaccctatgtgcgcggagataaagagaagacccaggaagagcgggctcagtatcgagagcggcagaaggaaattaaagaaagaaggaaagaacttaatacgctgcttcagaataggtatggcctgtctattcagtacattcccagccggcttagagaatacttgttgggttataaaaaggtcccctatgaaaagctagcgcttcagaaacttagagcgcagcgtaaggaagtcaaaaagaggatcaaggatatcgaaaaaatgcgcacccccagagtaggtgaacaggcaacctggctcgcagaggatatcgtttttttgactccgccaaagatgcacacgcctgaaaggaaaactaccaaacacccacagaagctcaataatgatcagttccggatcatgcaatcttccctggcgtacttttccgtaaataagaaagcaattaaaaagttctttcagaaggagacggggatcggtctgtcaaatagagaaacaagccatccgtttctgtataggatcgacgttgggaggtgcaggggtattttagacttctacacgggctacctgaaatacaaaatggactggctagatgatgcaatcaaaaaagttgataatcgtaaacatggcaagaaggaggctaaaaagtatgaaaaatatctaccctcatccattcagcataagactcctcttgaattagactacacccgcctgcctgtttatctaccaagaggcttatttaaaaaggcaattgtcaaagcgttagctgcacatgccgatttccaggtcgaaccagaggaagacaatgtaattttctgtctggaccagctcttggatggcgatacccaagatttctataattggcaacggtactatcgctctgcgctaacggaaaaagaaactgataaccagcttgtcctcgcccatccctacgcagagcaaatattaggtacaattaagacactggaaggtaagcagaagaacaataagcttgggaacaaggcgaaacaaaaaatcaaggatgaacttatagatctaaaaagagcaaaacggaggttactagaccgggaacaatacctacgggctgtacaagccgaagatcgtgcactatggctaatgatacaagagcggcaaaagcagaaagctgaacatgaggaaatcgcctttgatcagctcgaccttaaaaacatcactaaaatcctaacagagtctattgatgcccgactcagaataccggataccaaagtagatattacggataagcttccgctccgtagatatggagatctgcgccgtgtagctaaagatcgcagactggtcaatctcgcctcttactaccatgttgcaggtttatccgaaatcccctatgatcttgtgaagaaagaactggaagagtacgatcgccgtagagtggccttttttgagcacgtttatcagtttgaaaaagaagtatatgaccgctatgccgcagaacttagaaacgaaaatccgaaaggtgagagtacttacttcagtcattgggagtacgtagctgttgcggtaaagcactctgctgatactcattttaatgaactcttcaaagagaaagttatgcaattgcgtaacaagttccaccacaatgaattcccctatttcgactggttattgccagaggtagaaaaggcgagtgccgctctatacgcggatagagtctttgatgtggcagagggctactaccagaaaatgcgtaaattaatgcgacagtaa

SEQ ID NO: 11069 - RNA, 3408 nt, synthetic construct
  misc_feature 1..3408: note = Cas13b variant__Porohyromonas gingivalis__WP_012458151.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattccttacttgatttcctgcgcaatgatttctcgcacaatcggcttgatggcactacattcgagcatctcgaagtcagccctgacatcagctcctttattaccgggacatactccttggcatgcgggagagcacaatcgcggtttgcagttttcttcaagcccgacgactttgtcctggcaaagaacaggaaggaacaattgataagcgtagcggacggaaaagaatgcctgaccgttagtggctttgcctttttcatttgcctcttcctcgatagggagcaggcttccggtatgctgagcaggattcgcggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctggacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcagtcgatgggatttatcagtgtgcacgaccttcgtaagcttctcttgatggagttgctgtgtgaggggagcttcagccgtatgcagagtgatttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatggatcagagacaactgccctcacgtcttctggatgaatggatgaatatcaggcctgcaagccattcagtcaagcttcgtacttatgtcaagcagctcaatgaagactgccgactacgcctgcggaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccgccaattcagggctatcgtggcagaactgcgccttcttgacccctcttccgggcatccgttcctttccgcgaccatggagacagctcatcggtatacggaaggcttctacaaatgctatctcgagaagaaacgggaatggttggcaaaaattttctatcggccggaacaggacgagaatacaaaaaggcggataagcgtctttttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaaggtcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacgggacaaaaagcgagaactgcgaactgccggtaagcctgtccctcctgacttggctgccgacatcaagcggagctttcaccgagctgtcaatgaacgtgaatttatgctccgcctcgtgcaagaagacgatcggcttatgctgatggccatcaacaagatgatgaccgatagagaagaggatattctgcccggactgaaaaacatagacagcatattggatgaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagcggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccctgaaaatagattttttggaaagcttttgaataatatgtctcaacctatcaatgacttataa

SEQ ID NO: 11070 - RNA, 3408 nt, synthetic construct
  misc_feature 1..3408: note = Cas13b variant__Porohyromonas gingivalis__ERJ81987.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattctttacttgatttcctgcgcaatgatttctcgcacaatcggcttgatggcactacattcgagcatctcgaagtcagccctgacatcagctcctttattaccgggacatactccttggcatgcgggagagcacaatcgcggtttgcagatttcttcaagcccgacgactttgtcctggcaaagaacaggaaggaacaattgataagcgtagcggacggaaaagaatgcctgaccgttagtggccttgccttttttatttgcctcttcctcgatagggagcaggcttccggtatgctgagcaggattcgcggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcagtcgatgggatttatcagtgtgcacgaccttcgtaagcttctcttgatggagttgctgtgtgaggggagcttcagccgtatgcagagtggtttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatgaatcagagacaactgccctcacgtcttctggatgaatggatgaatatcaggcctgcaagccattcagtcaagcttcgtacttatgtcaagcagctcaatgaagactgccgactacgcctgcggaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccgccaattcagggctatcgtggcagaactgcaccttcttgacccctcttccggacatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaagatcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacaggacaaaaagcgagaactgcgaactgccggtaagcctgtccctcctgacttggctgccgacatcaagcggagctttcaccgagctgtcaatgaacgtgaatttatgctccgcctcgtgcaagaagacgatcggcttatgctgatggccatcaacaagatgatgaccgatagagaagaggatattctgcccggactgaaaaacatagacagcatattggatgaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagcggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccatgaaaatagattttttggaaagcttttgaataatatgtctcaacctatcaatgacttataa

SEQ ID NO: 11071 - RNA, 3408 nt, synthetic construct
  misc_feature 1..3408: note = Cas13b variant__Porohyromonas gingivalis__ERJ65637.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattctttacttgatttcctgcgcaatgacttctcgcacaatcggcttgatggcactacattcgagcatctcgaagtcagccctgacatcagctcctttattaccgggacatactccttggcatgcgggagagcacaatcgcggtttgcagatttcttcaagcccgacgactttgtcctggcaaagaacaggaaggaacaattgataagcgtagcggacggaaaagaatgcctgaccgttagtggccttgcctttttcatttgcctcttcctcgatagggagcaggcttccggtatgctgagcaggattcgcggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcggtcgatgggatttatcagtgtgcacgaccttcgtaagcttctcttgatggagttgctgtgtgaagggagcttcagccgtatgcagagtgatttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatggatcagagacaactgccctcacgtcttctggatgaatggatgaatatcaggcctgcaagccattcagtcaagcttcgtacttatgtcaagcagctcaatgaagactgccgactacgcctgcagaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccaccaattcagggctatcgtggcagaactgcgccttcttgacccctcttccgggcatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaagatcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacaggacaaaaagcgagaactgcgaactgccggtaagcctgtccctcctgacttggctgccgacatcaagcggagctttcaccgagctgtcaatgaacgtgaatttatgctccgcctcgtgcaagaagacgatcggcttatgctgatggccatcaacaagatgatgaccgatagagaagaggatattctgcccggactgaaaaacatagacagcatattggatgaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagcggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccctgaaaatagattttttggaaagcttttgaataatatgtctcaacctatcaatgacttataa

SEQ ID NO: 11072 - RNA, 3408 nt, synthetic construct
  misc_feature 1..3408: note = Cas13b variant__Porohyromonas gingivalis__WP_021665475.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattctttacttgatttcctgcgcaatgacttctcgcacaatcggcttgatggcactacattcgagcatctcgaagtcagccctgacatcagctcctttattaccgggacatactccttggcatgcgggagagcacaatcgcggtttgcagatttcttcaagcccgacgactttgtcctggcaaagaacaggaaggaacaattgataagcgtagcggacggaaaagaatgcctgaccgttagtggccttgccttttttatttgcctcttcctcgatagggagcaggcttccggtatgctgagcaggattcgcggattcaaacgaaccaatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcagtcgatgggatttatcagtgtgcacgaccttcgtaagcttctcttgatggagttgctgtgtgaggggagcttcagtcgtatgcagagtggtttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatgaatcagagacaactgccctcacgtcttctggatgaatggatgaatatcaggcctgcaagccattcagtcaagcttcgtacttatgtcaagcagctcaatgaagactgccgactacgcctgcggaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccgccaattcagggctatcgtggcagaactgcaccttcttgacccctcttccggacatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaagatcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacaggacaaaaagcgagaactgcgaactgccggtaagcctgtccctcctgacttggctgccgacatcaagcggagctttcaccgagctgtcaatgaacgtgaatttatgctccgcctcgtgcaagaagacgatcggcttatgctaatggccatcaacaagatgatgaccgatagagaagaggatattctgcccggactgaaaaacatagacagcatattggataaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagcggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccatgaaaatagattttttggaaagcttttgaataatatgtctcaacctatcaatgacttataa

SEQ ID NO: 11073 - RNA, 3408 nt, synthetic construct
  misc_feature 1..3408: note = Cas13b variant__Porohyromonas gingivalis__WP_061156637.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattctttacttgatttcctgcgcaatgatttctcgcacaatcggcttgatggcactacattcgagcatctcgaagtcagccctgacatcagctcctttattaccgggacatactccttggcatgcgggagagcacaatcgcggtttgcagatttcttcaagcccgacgactttgtcctggcaaagaacaggaaggaacaattgataagcgtagcggacggaaaagaatgcctgaccgttagtggccttgccttttttatttgcctcttcctcgatagggagcaggcttccggtatgctgagcaggattcgcggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcagtcgatgggatttatcagtgtgcacgaccttcgtaagcttctcttgatggagttgctgtgtgaggggagcttcagccgtatgcagagtggtttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatgaatcagagacaactgccctcacgtcttctggatgaatggatgaatatcaggcctgcaagccattcagtcaagcttcgtacttatgtcaagcagctcaatgaagactgccgactacgcctgcggaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccgccaattcagggctatcgtggcagaactgcaccttcttgacccctcttccggacatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaagatcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacaggacaaaaagcgagaactgcgaactgccggtaagcctgtccctcctgacttggctgccgacatcaagcggagctttcaccgagctgtcaatgaacgtgaatttatgctccgcctcgtgcaagaagacgatcggcttatgctaatggccatcaacaagatgatgaccgatagagaagaggatattctgcccggactgaaaaacatagacagcatattggataaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagcggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccctgaaaatagattttttggaaagcttttgaataatatgtctcaacctatcaatgacttataa

SEQ ID NO: 11074 - RNA, 3408 nt, synthetic construct
  misc_feature 1..3408: note = Cas13b variant__Porohyromonas gingivalis__WP_023846767.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattctttacttgatttcctgcgcaatgatttctcgcacaatcggcttgatggcactacattcgagcatctcgaagtcagccctgacatcagctcctttattaccgggacatactccttggcatgcgggagagcacaatcgcggtttgcagatttcttcaagcccgacgactttgtcctggcaaagaacaggaaggaacaattgataagcgtagcggacggaaaagaatgcctgaccgttagtggccttgccttttttatttgcctcttcctcgatagggagcaggcttccggtatgctgagcaggattcgcggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcggtcgatgggatttatcagtgtgcacgaccttcgtaagcttctcttgatggagttgctgtgtgaagggagcttcagccgtatgcagagtgatttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatgaatcagagacaactgccctcacgtcttctggatgaatggatgaatatcaggcctgcaagccattcagtcaagcttcgtacttatgtcaagcagctcaatgaagactgccgactacgcctgcggaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccgccaattcagggctatcgtggcagaactgcaccttcttgacccctcttccggacatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaagatcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacaggacaaaaagcgagaactgcgaactgccggtaagcctgtccctcctgacttggctgccgacatcaagcggagctttcaccgagctgtcaatgaacgtgaatttatgctccgcctcgtgcaagaagacgatcggcttatgctgatggccatcaacaagatgatgaccgatagagaagaggatattctgcccggactgaaaaacatagacagcatattggatgaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagtggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccctgaaaatagattttttggaaagcttttgaataatatgtctcaacctatcaatgacttataa

SEQ ID NO: 11075 - RNA, 3408 nt, synthetic construct
  misc_feature 1..3408: note = Cas13b variant__Porohyromonas gingivalis__ERJ87335.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattctttacttgatttcctgcgcaatgacttctcgcacaatcggcttgatggcactacattcgagcatctcgaagtcagccctgacatcagctcctttattaccgggacatactccttggcatgcgggagagcacaatcgcggtttgcagatttcttcaagcccgacgactttgtcctggcaaagaacaggaaggaacaattgataagcgtagcggacggaaaagaatgcctgaccgttagtggccttgcctttttcatttgcctcttcctcgatagggagcaggcttccggtatgctgagcaggattcgcggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcggtcgatgggatttatcagtgtgcacgaccttcgtaagcttctcttgatggagttgctgtgtgaagggagcttcagccgtatgcagagtgatttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatggatcagagacaactgccctcacgtcttctggatgaatggatgaatatcaggcctgcaagccattcagtcaagcttcgtacttatgtcaagcagctcaatgaagactgccgactacgcctgcagaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccaccaattcagggctatcgtggcagaactgcgccttcttgacccctcttccgggcatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaaggtcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacgggacaaaaagcgagaactgcgaactgccggtaagcctgtccctcctgacttggctgcctacatcaagcggagctttcaccgagctgtcaatgaacgtgaatttatgctccgcctcgtgcaagaagacgatcggcttatgctgatggccatcaacaagataatgaccgatagagaagaggatattctgcccggactgaaaaacatagacagcatattggataaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagtggagagcattctacactggtgaagatgctggtggagaagaaaggctgtctgactcctgacgaaagccaatacctgattctgattcgcaacaaggctgctcacaaccaatttccctgcgctgcagaaatacctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccctgaaaatagattttttggaaagcttttgaataatatgtctcaacctatcaatgacttataa

SEQ ID NO: 11076 - RNA, 3408 nt, synthetic construct
  misc_feature 1..3408: note = Cas13b variant__Porohyromonas gingivalis__WP_005873511.1__Cas13b
  source 1..3408: mol_type = other RNA
atgaatacagttcctgcttctgaaaacaaaggtcaatcccgtacagtggaagacgatccgcagtacttcggactttatctcaacctcgcacgagagaatttgatagaagtcgaaagtcatgttcgcattaagttcgggaagaagaaattgaatgaagagtcgctcaagcaatctcttctttgtgatcacctgctctccgtcgatcgctggaccaaagtctatggccatagcagacgctatctgcctttcctccattatttcgatccggatagtcagatcgaaaaagaccatgatagcaagaccggtgtggatcccgattcggcccaaaggctgatcagagagctttattctttacttgatttcctgcgcaatgacttctcgcacaatcggcttgatggcactacattcgagcatctcgaagtcagccctgacatcagctcctttattaccgggacatactccttggcatgcgggagagcacaatcgcggtttgcagatttcttcaagcccgacgactttgtcctggcaaagaacaggaaggaacaattgataagcgtagcggacggaaaagaatgcctgaccgttagtggccttgcctttttcatttgcctcttcctcgatagggagcaggcttccggtatgctgagcaggattcgcggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcagtcgatgggatttatcagtgtgcacaaccttcgtaagcttctcttgatggagttgctgtgtgaggggagcttcagccgtatgcagagtgatttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatgaatcagagacaactgccctcacgtcttctggatgaatggatgaatatcaggcctgcaagccattcagtcaagcttcgtacttatgtcaagcagctcaatgaagactgccgactacgcctgcggaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccgccaattcagggctatcgtggcagaactgcaccttcttgacccctcttccggacatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaagatcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacaggacaaaaagcgagaactgcgaactgccggtaagcctgtccctcctgacttggctgccgacatcaagcggagctttcaccgagctgtcaatgaacgtgaatttatgctccgcctcgtgcaagaagacgatcggcttatgctgatggccatcaacaagatgatgaccgatagagaagaggatattctgcccggactgaaaaacatagacagcatattggatgaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagcggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccctgaaaatagattttttggaaagcttttgaataatatgtctcaacctatcaatgacttataa

SEQ ID NO: 11077 - RNA, 3408 nt, synthetic construct
  misc_feature 1..3408: note = Cas13b variant__Porohyromonas gulae__WP_039445055.1__Cas13b
  source 1..3408: mol_type = other RNA
atgaatacagttcctgctactgaaaacaaaggccaatcccgtacagtggaagacgatcctcagtacttcggactttatctcaacctcgcacgagagaatttgatagaagtcgaaagtcatgttcgcattaagtttgggaagaagaaattgaatgaagagtcgctcaagcaatctcttctttgtgatcacctgctctccatcgatcgatggaccaaagtctatggacatagcagacgctatctgcctttcctccattgtttcgatccggatagtgggatcgaaaaagaccatgatagcaaaaccggtgtggatcccgattcggcccaaaggctgatcagagagctttattccttactcgatttcctgcgcaatgacttctcgcacaatcggcttgatggcactacattcgagcatctcaaagtcagccctgacatcagttcctttatcaccggggcatacacttttgcatgcgaaagagcacaatcgcgatttgcagatttcttcaagccggacgactttcttctggcaaagaacaggaaggaacaattgataagtgtagcggacggaaaagaatgcctgactgttagtggttttgcttttttcatttgcctcttcctcgatagggagcaggcatccggtatgctgagcaggattcgtggattcaaacgaaccgatgagaattgggcacgagccgtgcacgagaccttctgcgatctctgcatccgtcatcctcacgacaggctcgaaagcagcaatacgaaagaagctctcttgctcgatatgctcaacgaactgaaccgttgcccccgcatcctttacgatatgctccccgaagaggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtaggatgatcagtggagaggcgtcttatcccgtacgcttctctctctttgctccccgctatgccatatacgacaataagataggctattgccatacatccgaccctgtatatcctaagagtaagacaggggagaagagggccttgagcaatcctcagtcgatgggatttatcagtgtgcacgaccttcgtaagcttctcttgatggagttgctgtgtgaggggagcttcagccgtatgcagagtgatttcctcagaaaagcgaatcggatcctggatgaaacggcagagggaaaactacagttttcggcattattccctgagatgcgccaccgatttatccctccacagaatccgaagagcaaagaccggagggaaaaggctgaaacgactttggagaaatacaagcaggagataaaggggaggaaagacaagctcaatagccaactgctgtcggcattcgatatgaatcagagacaactgccctcacgtcttctggatgaatggatgaatatcaggcctgcaagccattcagtcaagcttcgtacttatgtcaagcagctcaatgaagactgccgactacgcctgcggaagtttcggaaggatggcgatgggaaagctcgtgccatacctctcgtcggtgaaatggctaccttcctctctcaggacatcgtccgcatgatcataagcgaagagacgaagaagctgatcacctccgcttactacaatgagatgcaacgctctctggcacaatatgccggagaagagaatcgccgccaattcagggctatcgtggcagaactgcaccttcttgacccctcttccggacatccgttcctttccgcgaccatggagacagctcatcggtatacggaagacttctacaaatgctatctcgagaagaaacgggaatggttggcaaaaactttctatcggccggaacaggacgagaatacaaaaaggcggataagcgtcttcttcgtgccggatggcgaagcacgaaaactactgcccctcctcatccgtcggcggatgaaggagcagaacgaccttcaggactggatccgaaacaagcaagcccaccccatagatctgccatcgcatctcttcgatagcaagatcatggagctactcaaggtcaaagacggaaagaagaaatggaatgaggcctttaaggactggtggagtaccaagtaccccgatggtatgcagcctttctatggactgcgcagagagctgaatatccacggcaaatctgtatcttatataccgtcagacggaaagaaattcgccgattgctacacgcatctgatggagaagaccgtacgggacaaaaagcgagaactgcgaactgccggtaagcctgtccctcctgacttggctgcctacatcaagcggagctttcaccgagctgtcaatgaacgtgaatttatgctccgcctcgtgcaagaagacgatcggcttatgctgatggccatcaacaagatgatgaccgatagagaagaggatattctgcccggactgaaaaacatagacagcatattggatgaggagaaccaattctcgctggctgtccatgctaaggtcttggagaaagagggtgaagggggtgataattctctttctcttgtgccggcaacgatcgaaatcaagagcaagcgtaaggattggtccaagtacatacgctaccggtacgatcgaagggtacccggacttatgtcccactttcccgagcacaaagctacgttggatgaagtcaagactttgttgggcgaatatgatcgctgccgcatcaaaatcttcgattgggcatttgcactcgaaggagccatcatgtctgatcgcgacttgaagccgtatttgcacgagtcgtcgagcagggagggtaagagcggagagcattctacactggtgaagatgctggtggagaagaaaggctgtctgactcctgacgaaagccaatacctgattctgattcgcaacaaggctgctcacaaccaatttccctgcgctgcagaaatgcctcttatttaccgagatgtgagtgcaaaggtcggtagcattgagggatcttctgccaaagatctgccggaaggtagttctctggtagattcattatggaaaaaatacgaaatgataattcggaaaattcttccgattctcgaccatgaaaatagattttttggaaagcttttgaataatatgtctcaacctatcaatgacttataa

SEQ ID NO: 11078 - RNA, 3528 nt, synthetic construct
  misc_feature 1..3528: note = Cas13b variant__Porphyromonas gingivalis__WP_052912312.1__Cas13b
  source 1..3528: mol_type = other RNA
atgacagaacaaaacgagaaaccgtacaacggtacctactacacgctggaggacaaacatttctgggcagctttcttcaatctggcacgtcacaacgcctatattaccctcgcccacatcgacaggcagctcgcctacagcaaggccgatataaccaacgatgaggatatactcttcttcaagggccaatggaaaaacctcgacaacgatctggagaggaaagctcggctgagaagtttgatcctgaagcatttctcctttttggaaggagccgcatacggcaagaaactcttcgaaagccaatcttccggaaacaaatcctccaagaagaaagaactcacaaaaaaagaaaaggaagaactgcaagccaacgcgctctccttggacaatctgaagagcatcctgttcgactttctgcaaaagctcaaggatttcaggaattactactcccactatcgacatcccgaatcttcggaattgcccttgttcgatggaaacatgcttcagagactgtacaacgtcttcgatgtgagtgtgcaacgggtgaaaagagatcacgagcacaacgacaaggtcgatcctcaccgccacttcaaccaccttgtcaggaaaggcaagaaagataagtacggcaataacgacaatcccttcttcaagcaccattttgtcgatagagaggagaaagtcacggaagccggactgctgtttttcgtctccctctttcttgaaaaaagggatgccatctggatgcaaaagaagatccgaggcttcaagggcggcaccgaagcctaccagcagatgaccaatgaggtcttctgccggagccggatctccttgccgaagctcaaactggagagcctgcgcacggacgactggatgctgctcgatatgctgaacgaactggttcgctgccccaagttgttgtacgatcgtcttcgcgaagaggatagagcgcgtttccgagtacccgtcgatattctgtccgatgaggacgatacggacggtacggaagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaagggcagcttctttggccgtcgccggaggtaggagcaacccgaacgggacgaagcaaatacgcccaagacaaacggttcacggcagaagccttcctgagcgtacatgagctgatgcccatgatgttctattacttcctgctgagagaaaagtattccgaggaggcaagtgccgagaaggtgcaaggaagaataaagagggtgatagaggatgtgtacgctgtctacgatgctttcgcccgagacgaaatcaatacgcgcgacgagttggatgcctgtttggcggacaagggtattcggcgaggacatctccccaggcaaatgatcgccatattgtcccaagagcataaggatatggaggagaaagtccgcaagaaacttcaggaaatgatagcggatacggatcatcgtctggatatgctggatcggcagaccgaccgaaagatcaggatcggcagaaagaatgccggcctgccgaagtcgggtgtcatagccgactggctggtacgggatatgatgcgctttcagcccgtggcgaaagacacgagtggcaagcctctgaacaatagcaaggccaacagcaccgaataccggatgctacagcgcgccctcgcccttttcggcggagagaaagagcgtctgacaccgtatttccgccagatgaatctgacgggagggaacaatccccatcctttcctgcacgaaacccggtgggagagccataccaatatcctgtccttctatcgcagctatctgaaagcaagaaaggcttttctccaaagcataggacgaagcgatcgggaggagaaccaccgcttcctcctgctcaaggaacccaaaaccgatcggcagacattagtggccggctggaagagcgaatttcatctgccacgcgggatttttaccgaagcggtcagagactgcctgatagagatggggtacgatgaagtcgggtcatacaaggaagtcggattcatggccaaagccgttccgctatatttcgagcgggcttgtaaagatcgggtacagcctttctatgactaccccttcaatgtaggcaacagcctcaagcccaagaaaggacgcttcctgagcaaagaaaagcgagccgaagagtgggagagcggtaaggagcggttccgagaccttgaggcttggtcgcacagtgctgctcgtcggatagaggatgcttttgtcggaatcgagtatgcaagttgggaaaataagaagaaaatcgagcagctgttgcaggatctctccctttgggaaacctttgagagcaagctgaaagtcaaggcagacaagataaatattgccaaactgaaaaaggaaatactcgaagccaaagaacacccctatcacgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgacgtccaagagcaggggagcctcaatgtgctgaaccacgtgaagccgatgcgcttgcccgtggtcgtgtacagagccgacagccgaggccatgtacacaaggaggaggctcctctggcgacggtctatatcgaagaaagggacaccaagctgctgaagcagggcaatttcaaatccttcgtcaaggatcgccggctcaacggccttttctctttcgtcgataccggcgcactcgcgatggagcagtacccgatcagcaagctcagggtggagtacgagctggctaagtatcagacggcaagggtctgtgccttcgagcagacgctggagctggaagagagcctgctgacccgatatcctcacttgccggatgagagcttcagagagatgctcgaaagctggtcggatcctctcttggacaagtggccggatctgcaaagggaagtccggcttctgatcgctgtgcgcaatgccttctcgcacaatcagtatcccatgtacgatgagaccatcttttcgtccatccggaagtacgacccctcttccctcgatgccatagaggaaaggatggggctgaacatcgcgcaccggttgagcgaggaagtgaagctggcaaaagaaatggtagaacgaatcatacaagcataa

SEQ ID NO: 11079 - RNA, 3360 nt, synthetic construct
  misc_feature 1..3360: note = Cas13b variant__Porphyromonas gingivalis__WP_053444417.1__Cas13b
  source 1..3360: mol_type = other RNA
atgacagaacaaaacgagaaaccgtacaacggtacctactacacgctggaggacaaacatttctgggcagctttcctcaatctggcacgtcacaacgcctatattaccctcgcccacatcgacaggcagctcgcctacagcaaagccgatataaccaacgatgaggatatactcttcttcaagggccaatggaaaaacctcgacaacgatctggagaggaaagctcggctgagaagtttgatcctgaagcatttctcctttttggaaggagccgcatacggcaagaaactcttcgaaagccaatcttccggaaacaaatcctccaagaagaaagaactctcgaaaaaagaaaaggaggaactgcaagccaatgcactctccttggacaatctgaagagcatcctgttcgactttctgcaaaagctcaaggatttcaggaattactactcccactatcgacatcccgaatcttcggaattgcccctgttcgatggaaacatgcttcagagactatacaacgtcttcgatgtgagtgtgcaacgggtgaaaagagatcacgagcacaacgacaaggtcgatccccaccgccacttcaaccaccttgtcaggaaaggcaagaaggataagtacggcaataacgacaatcccttcttcaagcaccattttgtcgatagagaggggacggtcacggaagccggactgctgtttttcgtctccctctttcttgagaaaagggatgccatctggatgcaaaagaagatccgaggcttcaagggcggcaccgaagcctaccagcagatgaccaacgaggtcttctgccggagccggatctccttgccgaagctcaaactggagagcctgcgcacggacgactggatgctgctcgatatgctgaacgaactggttcgctgtcccaagtcgttgtacgatcgtcttcgcgaagaggatagagcgcgtttccgagtacccgtcgatattctgtccgatgaggacgatacggacggtacggaagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaagggcagcatctttggccgtcgccggaggtaggagcaacccgaacgggacgaagcaaatacgcccaagacaaacggctcacggcagaagccttcctgagcgtgcatgaactgatgcccatgatgttctattacttcctgctgagagaaaagtattccgaggaggtaagtgccgagaaggtgcaaggaagaataaagagggtgatagaggatgtgtacgctgtctacgatgctttcgcccgagacgaaatcaatacgcgcgacgagttggatgcctgtttggcggacaagggtattcggcgaggacatctccccaggcaaatgatcgccatattgtcccaagagcataaggatatggaggagaaagtccgcaagaaacttcaggaaatgatagcggatacggatcatcgtctggatatgctggatcggcagaccgaccgaaagatcaggatcggccgaaagaatgccggcctgccgaagtcgggtgtcgtagccgactggctggtacgggatatgatgcgctttcagcccgtggcgaaagacacgagtggcaagcctctgaacaatagcaaggccaacagcaccgaataccggatgctacagcgcgccctcgcccttttcggtggagagaaagagcgtctgacaccgtatttccgccagatgaatctgacgggagggaacaatccccatcctttcctgcacgagacccggtgggagagccataccaatatcctgtccttctatcgcagctatctggaagcaagaaaggcttttctccaaagcataggacgaagcgatcgggtggagaaccaccgcttcctcctgctcaaggaacccaaaaccgatcggcagacattagtggcaggctggaagggcgaatttcatctgccacgcggcatttttaccgaagcggtcagagactgcctgatagagatggggtacgatgaagtcgggtcatacaaggaagtcggattcatggccaaagccgttccgctgtatttcgagcgggcttctaaagatcgggtacagcctttctatgactaccccttcaatgtaggcaacagcctcaagcccaagaaaggacgcttcctgagcaaagaaaagcgagccgaagagtgggagagcggtaaggagcggttccgactcgccaaactgaaaaaggaaatactcgaagccaaagaacacccctatcacgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgacgtccaagagcaggggagcctcaatgtgctgaaccgcgtgaagccgatgcgcttgcccgtggtcgtgtacagagccgacagccgaggccatgtacacaaggagcaggctcctctggcgacggtctatatcgaagaaagggacaccaagctgctgaagcagggcaatttcaaatcctttgtcaaggatcgccggctcaacggccttttctctttcgtcgataccggcgcactcgcgatggagcagtacccgatcagcaagctcagggtggagtacgagctggccaagtatcagacggcaagggtctgtgccttcgagcagacgctggagctggaagagagcctgctgacccgatatcctcacttgccggataagaacttcagaaagatgctcgaaagctggtcggatcctctcttggacaagtggccggatctgcacgggaatgtccggcttctgatcgctgtgcgcaatgccttctcgcacaatcagtatcccatgtacgatgagaccctcttttcgtccatccggaagtacgacccctcttcccccgatgcaatagaggaaaggatggggctgaacatcgcgcaccggttgagcgaggaagtgaagcaggcaaaagaaatggtagaacgaatcatacaagcataa

SEQ ID NO: 11080 - RNA, 3360 nt, synthetic construct
  misc_feature 1..3360: note = Cas13b variant__Porphyromonas gingivalis__WP_012458414.1__Cas13b
  source 1..3360: mol_type = other RNA
atgacagaacaaaacgagagaccgtacaacggtacctactacacgctggaggacaaacatttctgggcagctttcttcaatctggcacgtcacaacgcctatattaccctcgcccacatcgacaggcagctcgcctacagcaaggccgatataaccaacgatgaggatatactcttcttcaagggccaatggaaaaacctcgacaacgatctggagaggaaagctcggctgagaagtttgatcctgaagcatttctcctttttggaaggagccgcatacggaaagaaactcttcgaaagccaatcttccggaaacaaatcctccaagaagaaagaactcacgaaaaaagaaaaggaggaactgcaagccaatgcactctccttggacaatctgaagagcatcctgttcgactttctgcaaaagctcaaggatttcaggaattactactcccactatcgacatcccgaatcttcggaattgcccttgtttgatggaaacatgcttcagagactgtacaacgtcttcgatgtgagtgtgcaacgggtgaaaagagatcacgagcacaacgacaaggtcgatccccaccgccacttcaaccaccttgtcaggaaaggcaagaaggataggtacggcaataacgacaatcccttcttcaagcaccattttgtcgatagagaggagaaagtcacggaagccggactgctgtttttcgtctccctctttcttgagaaaagggatgccatctggatgcaaaagaagatccgaggcttcaagggcggcaccgaaacctaccagcagatgaccaacgaggtcttctgccggagccggatctccttgccgaagctcaaactggagagcctgcgcacggacgactggatgctgctcgatatgctgaacgaactggttcgctgtcccaagtcgttgtacgatcgtcttcgcgaagaggatagagcgcgtttccgagtacccgtcgatattctgtccgatgaggacgatacggacggtacggaagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaaggacagcatctttggccgtcgccggaggtaggagcaacccgaacggggcgaagcaaatacgcccaagacaaacggctcacggcagaagccttcctgagcgtacatgagctgatgcccatgatgttctactacttcctgctgagagaaaagtattccgatgaggcaagtgccgagagggtgcaaggaagaatcaagagggtgatagaggatgtgtacgctgtctacgatgctttcgcccgaggcgaaatcaatacgcgcgacgagttggatgcctgtttggcggacaagggtattcggcgaggacatctccccaggcaaatgatcggcatattgtcccaagagcataaggatatggaggagaaagtccgcaagaaacttcaggaaatgatagtggatacggatcaccgtctggatatgctggatcggcagaccgaccgaaagatcaggatcggcagaaagaatgccggcctgcccaagtcgggcgtcatagccgactggctggtacgggatatgatgcgctttcagcccgtggcgaaagacacgagcggcaagcctctgaacaatagcaaggccaacagcaccgaataccggatgctacagcgcgccctcgcccttttcggtggagagaaagagcgtctgacaccgtatttccgccagatgaatctgacgggagggaacaatccccatcctttcctgcacgagacccggtgggagagccataccaatatcctgtccttctatcgcagctatctgaaagcaagaaaggcttttctccaaagcataggacgaagcgatcgggtggagaaccaccgcttcctcctgctcaaggaacccaaaaccgatcggcagacattagtggcaggctggaagggcgaatttcatctgccacgcgggatttttaccgaagcggtcagagactgcctgatagagatggggctcgatgaagtcgggtcatacaaggaagtcggattcatggccaaagccgttccgctgtatttcgagcgggcttgtaaagatcgggtacagcctttctatgactaccccttcaatgtaggcaacagcctcaagcccaagaaaggacgcttcctgagcaaagaaaagcgtgccgaagagtgggagagcggtaaggagcggttccgactcgccaaactgaaaaaggaaatactcgaagccaaagaacacccctatctcgacttcaagtcgtggcagaagttcgagcgcgaactgcgccttgtcaagaatcaggatattatcacttggatgatatgcagggatctcatggaagagaacaaggtggagggattggataccggtactctctacctgaaagatattcggaccgacgtccaagagcagggaaacctcaatgtactgaaccgcgtgaagccgatgcgcttgcccgtggtcgtgtacagagccgacagccgaggccatgtacacaaggagcaggctcctctggcgacggtctatatcgaagaaagggacaccaagctgctgaagcagggcaatttcaaatccttcgtcaaggatcgccggctcaacggccttttctctttcgtcgataccggcgcactcgcgatggagcagtacccgatcagcaagctcagggtggagtacgagctggccaagtatcagacggcaagggtctgtgccttcgagcagacgctggagctggaagagagcctgctgacccgatatcctcacttgccggataagaacttcagaaagatgctcgaaagctggtcggatcctctcttggacaagtggccggatctgcacgggaatgtccggcttctgatcgctgtgcgcaatgccttctcgcacaatcagtatcccatgtacgacgaggccgtcttttcgtctattcggaagtacgacccctcttcccccgatgccatagaggaaaggatggggctgaacatcgcgcaccggttgagcgaggaagtgaagcaggcaaaagaaatggcagaacgaatcatacaagcataa

SEQ ID NO: 11081 - RNA, 3360 nt, synthetic construct
  misc_feature 1..3360: note = Cas13b variant__Porphyromonas gingivalis__WP_039417390.1__Cas13b
  source 1..3360: mol_type = other RNA
atgacagaacaaaacgagagaccgtacaacggtacctactacacgctggaggacaaacatttctgggcagctttcttcaatctggcacgtcacaacgcctatattaccctcgcccacatcgacaggcagctcgcctacagcaaggccgatataaccaacgatgaggatatactcttcttcaagggccaatggaaaaacctcgacaacgatctggagaggaaagctcggctgagaagtttgatcctgaagcatttctcctttttggaaggagccgcatacggcaagaaactcttcgaaagccaatcttccggaaacaaatcctccaagaagaaagaactcacgaaaaaagaaaaggaggaactgcaagccaatgcactctccttggacaatctgaagagcatcctgttcgactttctgcaaaagctcaaggatttcaggaattactactcccactatcgacatcccgaatcttcggaattgcccttgttcgatggaaacatgcttcagagactgtacaacgtcttcgatgtgagtgtgcaacgggtgaaaagagatcacgagcacaacgacaaggtcgatccccaccgccacttcaaccaccttgtcaggaaaggcaagaaggacaggtacggcaataacgacaatcccttcttcaagcaccattttgtcgatagagaggggacggtcacggaagccggactgctgtttttcgtctccctctttcttgaaaaaagggatgccatctggatgcaaaagaagatccgaggcttcaagggcggcaccgaagcctaccagcagatgaccaacgaggtcttctgccggagccggatctccttgccgaagctcaaactggagagcctgcgcacggacgactggatgctgctcgatatgctgaacgaactggttcgctgtcccaagtcgttgtacgatcgtcttcgagaagaggatagagcgcgtttccgagtacccatcgatattctgtccgatgaagacgatacggacggtacggaagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaaggacagcatctttggccgtcgccggaggtaggagcaacccgaacgggacgaagcaaatacgcccaagacaaacggctcacggcagaagccttcctgagcgtgcatgagctgatgcccatgatgttctactacttcctgctgagggagaagtattccgaggaggtaagtgccgagaaggtgcaaggaagaatcaagagggtgatagaggatgtgtacgctgtctacgatgctttcgcccgaggcgaaattgatacgcttgaccggctggatgcctgtttggcggacaagggtattcggcgaggacatctcccccggcaaatgatcgccatattgtcccaagagcataaggatatggaggagaaagtccgcaagaaacttcaggaaatgatagcggatacggatcaccgtctggatatgctggatcggcagaccgaccgaaagatcaggatcggcagaaagaatgccggcctgcccaagtcgggcgtcatagccgactggctggtacgggatatgatgcgctttcagcccgtggcgaaagacacgagtggcaagcctctgaacaatagcaaggccaacagcaccgaataccggatgctacagcgcgccctcgcccttttcggcggagagaaagagcgtctgacaccgtatttccgccagatgaatctgacgggagggaacaatccccatcctttcctgcacgaaacccggtgggagagccataccaatatcctgtccttctatcgcagctatctgaaagcaagaaaggcttttctccaaagcataggacgaagcgatcgggaggagaaccaccgcttcctcctgctcaaggaacccaaaaccgatcggcagacattagtggccggctggaagagcgaatttcatctgccacgcgggatttttaccgaagcggtcagagactgcctgatagagatggggtacgatgaagtcgggtcatacaaggaagtcggattcatggccaaagccgttccgctatatttcgagcgggcttgtaaagatcgggtacagcctttctatgactaccccttcaatgtaggcaacagcctcaagcccaagaaaggacgcttcctgagcaaagaaaagcgagccgaagagtgggagagcggtaaggagcggttccgactcgccaaactgaaaaaggaaatactcgaagccaaagaacacccctatctcgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgacgtccatgagcaggggagcctcaatgtgctgaaccgcgtgaagccgatgcgcttgcccgtggtcgtgtacagagccgacagccgaggccatgtacacaaggagcaggctcctctggcgacggtctatatcgaagaaagggacaccaagctgctgaagcagggcaatttcaaatccttcgtcaaggatcgccggctcaacggccttttctctttcgtcgataccggcgcactcgcgatggagcagtacccgatcagcaagctcagggtggagtacgagctggccaagtatcagacggcaagggtctgtgccttcgagcagacgctggagctggaagagagcctgctgacccgatatcctcacttgccggataagaacttcagaaagatgctcgaaagctggtcggatcctctcttggacaagtggccggatctgcaccggaaagtccggcttctgatcgctgtgcgcaatgccttctcgcacaatcagtatcccatgtacgacgaggccgtcttttcgtccatccggaagtacgacccctcttcccccgatgccatagaggaaaggatggggctgaacatcgcgcaccggttgagcgaggaagtgaagcaggcaaaagaaatggcagaacgaatcatacaagtataa

SEQ ID NO: 11082 - RNA, 3528 nt, synthetic construct
  misc_feature 1..3528: note = Cas13b variant__Porphyromonas gingivalis__EOA10535.1__Cas13b
  source 1..3528: mol_type = other RNA
atgacagaacaaaacgagaaaccgtacaacggtacctactacacgctggaggacaaacatttctgggcagctttcttcaatctggcacgtcacaacgcctatattaccctcacccacatcgacaggcagctcgcctacagcaaggccgatataaccaacgatgaggatatactcttcttcaagggccaatggaaaaacctcgacaacgatctggagaggaaagctcggctgagaagtttgatcctgaagcatttctcctttttggaaggagctgcatacggaaagaaactcttcgaaagccaatcttccggaaacaaatcctccaagaagaaagaactcacgaaaaaagaaaaggaggaactgcaagccaatgcactctccttggacaatctgaagagcatcctgttcgactttctgcaaaagctcaaggatttcaggaattactactcccactatcgacatcccgaatcttcggaattgcccttgttcgatggaaacatgcttcagagactgtacaacgtcttcgatgtgagtgtgcaacgggtgaaaagagatcacgagcacaacgacaaggtcgatccccaccgccacttcaaccaccttgtcaggaaaggcaagaaagataggtgcggcaataacgacaatcccttcttcaagcaccattttgtcgatagagaggagaaagtcacggaagccggactgctgtttttcgtctccctctttcttgaaaaaagggatgccatctggatgcaaaagaagatacgaggattcaagggcggcaccgaaacctaccagcagatgaccaacgaggtcttctgccggagccggatctccttgccgaagctcaaactggagagcctgcgcacggacgactggatgctgctcgatatgctgaacgaactggttcgctgtcccaagtcgttgtacgatcgtcttcgcgaagaggatagagcgcgtttccgagtacccgtcgatattctgtccgatgaggacgatacggacggtacggaagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaagggcagcttctttggccgtcgccggaggtaggagcaacccgaacgggacgaagcaaatacgcccaagacaaacggttcacggcagaagccttcctgagcgtacatgagctgatgcccatgatgttctattacttcctgctgagagaaaagtattccgaggaggcaagtgccgagagggtgcaaggaaggatcaagagggtgatagaggatgtgtacgctgtctacgatgctttcgcccgaggcgaaatcgatacgcttgaccggctggatgcctgtttggcggacaagggtattcggcgaggacatctcccccggcaaatgatcgccatattgtcccaagagcataaggatatggaggagaaagtccgcaagaaacttcaggaaatgatagcggatacggatcaccgtctggatatgctggatcggcagaccgaccgaaagatcaggatcggcagaaagaatgccggcctgcccaagtcgggcgtcatagccgactggttggtacgggatatgatgcgctttcagcccgtggcgaaagacacgagcggcaagcctctgaacaatagcaaggccaacagcaccgaataccggatgctacagcgcgccctcgcccttttcggtggagagaaagagcgtctgacaccgtatttccgccagatgaatctgacgggagggaacaatccccatcctttcctgcacgagacccggtgggagagccataccaatatcctgtccttctatcgcagctatctgaaagcaagaaaggcttttctccaaagcataggacgaagcgatcgggtggagaaccaccgcttcctcctgctcaaggaacccaaaaccgatcggcagacattagtggccggctggaagggcgaatttcatctgccacgcgggatttttaccgaagcggtcagagactgcctgatagagatggggctcgatgaagtcgggtcatacaaggaagtcggattcatggccaaagccgttccgctgtatttcgagcgggcttgtaaagatcgggtacagcctttctatgactaccccttcaatgtaggcaacagcctcaagcccaagaaaggacgcttcctgagcaaagaaaagcgagccgaagagtgggagagcggtaaggagcggttccgagaccttgaagcttggtcgcacagtgctgctcgtcggatagaggatgcttttgccggaatcgagaatgcaagccgggaaaataagaagaaaatcgagcagctgttgcaggatctctccctttgggaaacctttgagagcaagctgaaagtcaaggcagacaagataaatatcgccaaactgaaaaaggaaatactcgaagccaaagaacacccctatctcgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgacgtccatgagcaggggagcctcaatgtgctgaaccgcgtgaagccgatgcgcttgcccgtggtcgtgtacagagccgacagccgaggccatgtacacaaggagcaggctcctctggcgacggtctatatcgaagaaagggacaccaagctgctgaagcagggcaatttcaaatccttcgtcaaggatcgccggctcaacggccttttctctttcgtcgataccggcgcactcgcgatggagcagtacccgatcagcaagctcagggtggagtacgagctggccaagtatcagacggcaagggtctgtgccttcgagcagacgctggagctggaagagagcctgctgacccgatatcctcacttgccggataagaacttcagaaagatgctcgaaagctggtcggatcctctcttggacaagtggccggatctgcacgggaatgtccggcttctgatcgctgtgcgcaatgccttctcgcacaatcagtatcccatgtacgatgagaccctcttttcgtccatccggaagtacgacccctcttcccccgatgcaatagaggaaaggatggggctgaacatcgcgcaccggttgagcgaggaagtgaagcaggcaaaagaaatggtagaacgaatcatacaagcataa

SEQ ID NO: 11083 - RNA, 3360 nt, synthetic construct
  misc_feature 1..3360: note = Cas13b variant__Porphyromonas gingivalis__WP_061156470.1__Cas13b
  source 1..3360: mol_type = other RNA
atgacagaacaaaacgagagaccgtacaacggtacctactacacgctggaggacaaacatttctgggcagctttcttcaatctggcacgtcacaacgcctatattaccctcacccacatcgacaggcagctcgcctacagcaaggccgatataaccaacgatgaggatatactcttcttcaagggccaatggaaaaacctcgacaacgatctggagaggaaagctcggctgagaagtttgatcctgaagcatttctcctttttggaaggagccgcatacggaaagaaactcttcgaaaacaaatcttccggaaacaaatcctccaagaagaaagaactcacgaaaaaagaaaaggaggaactgcaagccaatgcactctccttggacaatctgaagagcatcctgttcgactttctgcaaaagctcaaggatttcaggaattactactcccactatcgacatcccgaatcttcggaattgcccttgttcgatggaaacatgcttcagagactgtacaacgtcttcgatgtgagtgtgcaacgggtgaaaagagatcacgagcacaacgacaaggtcgatccccaccgccacttcaaccaccttgtcaggaaaggcaagaaagataggtgcggcaataacgacaatcccttcttcaagcaccattttgtcgatagagaggggaaagtcacggaagccggactgctgtttttcgtctccctctttcttgagaaaagggatgccatctggatgcaaaagaagatccgaggcttcaagggcggcaccgaagcctaccagcagatgaccaacgaggtcttctgccggagccggatctccttgccgaagctcaaactggagagcctgcgcacggacgactggatgctgctcgatatgctgaacgaactggttcgctgtcccaagtcgttgtacgatcgtcttcgcgaagaggatagagcgcgtttccgagtacccgtcgatattctgtccgatgaggacgatacggacggtacggaagaagaccccttcaaaaacacgctggtcaggcatcaggatcgcttcccctactttgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaagggcagcatctttggccgtcgccggaggtaggagcaacccgaacgggacgaagcaaatacgcccaagacaaacggctcacggcagaagccttcctgagcgtgcatgagctgatgcccatgatgttctactacttcctgctgagggagaagtattccgaggaggtaagtgccgagaaggtgcaaggaagaatcaagagggtgatagaggatgtgtacgctgtctacgatgctttcgcccgaggcgaaattgatacgcttgaccggctggatgcctgtttggcggacaagggtattcggcgaggacatctcccccggcaaatgatcgccatattgtcccaagagcataaggatatggaggagaaagtccgcaagaaacttcaggaaatgatagcggatacggatcaccgtctggatatgctggatcggcagaccgaccgaaagatcaggatcggcagaaagaatgccggcctgcccaagtcgggcgtcatagccgactggctggtacgggatatgatgcgctttcagcccgtggcgaaagacacgagtggcaagcctctgaacaatagcaaggccaacagcaccgaataccggatgctacagcgcgccctcgcccttttcggcggagagaaagagcgtctgacaccgtatttccgccagatgaatctgacgggagggaacaatccccatcctttcctgcacgaaacccggtgggagagccataccaatatcctgtccttctatcgcagctatctgaaagcaagaaaggcttttctccaaagcataggacgaagcgatcgggaggagaaccaccgcttcctcctgctcaaggaacccaaaaccgatcggcagacattagtggccggctggaagagcgaatttcatctgccacgcgggatttttaccgaagcggtcagagactgcctgatagagatggggtacgatgaagtcgggtcatacaaggaagtcggattcatggccaaagccgttccgctatatttcgagcgggcttgtaaagatcgggtacagcctttctatgactaccccttcaatgtaggcaacagcctcaagcccaagaaaggacgcttcctgagcaaagaaaagcgagccgaagagtgggagagcggtaaggagcggttccgactcgccaaactgaaaaaggaaatactcgaagccaaagaacacccctatctcgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgaagtccaagagcaggggagcctcaatgtgctgaatcgcgtgaagccgatgcgcttgcccgtggtcgtgtacagagccgacagccgaggccatgtacacaaggagcaggctcctctggcgacggtctatatcgaagaaagggacaccaagctgctgaagcagggcaatttcaaatcctttgtcaaggaccgccggctcaacggtcttttctctttcgtcgataccggcggactcgcgatggagcagtacccgatcagcaagctcagggtggagtacgagctggccaagtatcagacggcaagggtctgtgccttcgagcagacgctggagctggaagagagcctgctgacccgatgtcctcacttgccggataagaacttcagaaagatgctcgaaagctggtcggatcctctcttggacaagtggccggatctgcaaagggaagtctggcttctgatcgctgtgcgcaatgccttctcgcacaatcagtatcccatgtacgacgaggccgtcttttcgtccatccggaagtacgacccctcttcccccgatgccatagaggaaaggatggggctgaacatcgcgcaccggttgagcgaggaagtgaagcaggcaaaagaaatggcagaacgaatcatacaagcataa

SEQ ID NO: 11084 - RNA, 3360 nt, synthetic construct
  misc_feature 1..3360: note = Cas13b variant__Porphyromonas gingivalis__WP_013816155.1__Cas13b
  source 1..3360: mol_type = other RNA
atgacagaacaaaacgagaaaccgtacaacggtacctactacacgctggaggacaaacatttctgggcagctttcttcaatctggcacgtcacaacgcctatattaccctcgcccacatcgacaggcagctcgcctacagcaaagccgatataaccaacgatgaggatatactcttcttcaagggccaatggaaaaacctcgacaacgatctggagaggaaagctcggctgagaagtttgatcctgaagcatttctcctttttggaaggagccgcatacggcaagaaactcttcgaaagccaatcttccggaaacaaatcctccaagaataaagaactcacaaaaaaagaaaaggaggagctgcaagccaatgcactctccttggacaatctgaagagcatcctgttcgactttctgcaaaagctcaaggatttcaggaattactactcccactatcgacatcccgaatcttcggaattgcccttgttcgatggaaacatgcttcagagactgtacaacgtcttcgatgtgagtgtgcaacgggtgaaaagagatcacgagcacaacgacaaggtcgatccccaccgccacttcaaccaccttgtcaggaaaggcaagaaagataggtacggcaataacgacaatcccttcttcaagcaccattttgtcgatagagaggggacggtcacggaagccggactgctgtttttcgtctccctctttcttgagaaaagggatgccatctggatgcaaaagaagatccgaggcttcaagggcggcaccgaaacttaccagcagatgaccaacgaggtcttctgccggagccggatctccttgccgaagctcaaactggagagcctgcgcacggacgactggatgctgctcgatatgctgaacgaactggttcgctgtcccaagtcgttgtacgatcgtcttcgcgaagaggatagagcgcgtttccgagtacccgtcgatattctgtccgatgaggaggatacggacggtgcggaagaagaccccttcaaaaacacgctggtcaggcatcaggatcgcttcccctacttcgccttgcgatacttcgatctgaagaaagtcttcacttccctccgcttccagatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaaggacagcatctttggccgtcgccggaggtaggagcaacccgaacgggacgaagcaaatacgcccaagacaaacggttcacggcagaagccttcctgagcgcacatgagctgatgcccatgatgttctattacttcctgctgagagaaaagtattccgaagaggcaagtgccgagagggtgcaaggaagaataaagagggtgatagaggatgtgtacgctgtctacgatgctttcgcccgagacgaaatcaatacgcgcgacgagttggatgcctgtttggcggacaagggtattcggcgaggacatctccccaggcaaatgatcggcatattgtcccaagagcataaggatatggaggagaaaatccgcaagaaacttcaggaaatgatggcggatacggatcaccgtctggatatgctggatcggcagaccgaccgaaagatcaggattggcagaaagaatgccggcctgcccaagtcgggcgtcatagccgactggctggtacgggatatgatgcgctttcagcccgtggcgaaagacacgagcggcaaacccctgaacaatagcaaggccaacagcaccgaataccggatgctacagcgcgccctcgcccttttcggtggagagaaagagcgtctgacaccgtatttccgccagatgaatctgacgggagggaacaatccccatcctttcctgcacgagacccggtgggagagccataccaatatcctgtccttctatcgcagctatctgaaagcaagaaaggcttttctccaaagcataggacgaagcgatcgggtggagaaccaccgcttcctcctgctcaaggaacccaaaaccgatcggcagacattggtggcaggctggaagggcgaatttcatctgccacgcgggatttttaccgaagcggtcagagactgcctgatagagatggggctcgatgaagtcgggtcatacaaggaagtcggattcatggccaaagccgttccgctgtatttcgagcgggcttgtaaagattgggtacagcctttctataactaccccttcaatgtaggcaacagcctcaagcccaagaaaggacgcttcctgagcaaagaaaagcgtgccgaagagtgggagagcggtaaggagcggttccgactcgccaaactgaaaaaggaaatactcgaagccaaagaacacccctatctcgacttcaagtcgtggcagaagttcgagcgcgaactgcgccttgtcaagaatcaggatattatcacttggatgatatgcggggatctcatggaagagaacaaggtggagggattggataccggtactctctacctgaaagatattcggaccgacgtccaagagcaggggagcctcaatgtgctgaaccgcgtgaagccgatgcgcttgcccgtggtcgtgtacagagccgacagccgaggccatgtacacaaggagcaggctcctctggcgacggtctatatcgaagaaagggacaccaagctgctgaagcagggcaatttcaaatcctttgtcaaggatcgccggctcaacggccttttctctttcgtcgataccggcgcactcgcgatggagcagtacccgatcagcaagctcagggtggagtatgagctggccaagtatcagacggcaagggtttgtgccttcgagcagacgctggagctggaagagagcctgctgacccgatgtcctcacttgccggataagaacttcagaaagatgctcgaaagctggtcggatcctctcttggacaagtggccggatctgcaccggaaagtccgacttctgatcgctgtgcgcaatgccttctcgcacaatcagtatcccatgtacgacgaggccgtcttttcgtccatccggaagtacgacccctctttccccgatgccatagaggaaaggatggggctgaacatcgcgcaccggttgagcgaggaagtgaagcaggcaaaagaaacggtagaacgaatcatacaagcataa

SEQ ID NO: 11085 - RNA, 3528 nt, synthetic construct
  misc_feature 1..3528: note = Cas13b variant__Porphyromonas gingivalis__WP_005874195.1__Cas13b
  source 1..3528: mol_type = other RNA
atgacagaacaaaacgagaaaccgtacaacggtacctactacacgctggaggacaaacatttctgggcagctttcttcaatctggcacgtcacaacgcctatattaccctcgcccacatcgacaggcagctcgcctacagcaaggccgatataaccaacgatgaggatatactcttcttcaagggccaatggaaaaacctcgacaacgatctggagaggaaagctcggctgagaagtttgatcctgaagcatttctcctttttggaaggagccgcatacggcaagaaactcttcgaaagccaatcttccggaaacaaatcctccaagaagaaagaactcacaaaaaaagaaaaggaagaactgcaagccaacgcgctctccttggacaatctgaagagcatcctgttcgactttctgcaaaagctcaaggatttcaggaattactactcccactatcgacatcccgaatcttcggaattgcccttgttcgatggaaacatgcttcagagactgtacaacgtcttcgatgtgagtgtgcaacgggtgaaaagagatcacgagcacaacgacaaggtcgatcctcaccgccacttcaaccaccttgtcaggaaaggcaagaaagataagtacggcaataacgacaatcccttcttcaagcaccattttgtcgatagagaggagaaagtcacggaagccggactgctgtttttcgtctccctctttcttgaaaaaagggatgccatctggatgcaaaagaagatccgaggcttcaagggcggcaccgaagcctaccagcagatgaccaatgaggtcttctgccggagccggatctccttgccgaagctcaaactggagagcctgcgcacggacgactggatgctgctcgatatgctgaacgaactggttcgctgccccaagtcgttgtacgatcgtcttcgcgaagaggatagagcgcgtttccgagtacccgtcgatattctgtccgatgaggacgatacggacggtacggaagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagaacatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatcacccaaaccactccgcactatcatatcgagaaaggaaagatcgggctgaggttcgtgccggaagggcagcttctttggccgtcgccggaggtaggagcaacccgaacgggacgaagcaaatacgcccaagacaaacggttcacggcagaagccttcctgagcgtacatgagctgatgcccatgatgttctattacttcctgctgagagaaaagtattccgaggaggcaagtgccgagaaggtgcaaggaagaataaagagggtgatagaggatgtgtacgctgtctacgatgctttcgcccgagacgaaatcaatacgcgcgacgagttggatgcctgtttggcggacaagggtattcggcgaggacatctccccaggcaaatgatcgccatattgtcccaagagcataaggatatggaggagaaagtccgcaagaaacttcaggaaatgatagcggatacggatcatcgtctggatatgctggatcggcagaccgaccgaaagatcaggatcggcagaaagaatgccggcctgccgaagtcgggtgtcatagccgactggctggtacgggatatgatgcgctttcagcccgtggcgaaagacacgagtggcaagcctctgaacaatagcaaggccaacagcaccgaataccggatgctacagcgcgccctcgcccttttcggcggagagaaagagcgtctgacaccgtatttccgccagatgaatctgacgggagggaacaatccccatcctttcctgcacgaaacccggtgggagagccataccaatatcctgtccttctatcgcagctatctgaaagcaagaaaggcttttctccaaagcataggacgaagcgatcgggaggagaaccaccgcttcctcctgctcaaggaacccaaaaccgatcggcagacattagtggccggctggaagagcgaatttcatctgccacgcgggatttttaccgaagcggtcagagactgcctgatagagatggggtacgatgaagtcgggtcatacaaggaagtcggattcatggccaaagccgttccgctatatttcgagcgggcttgtaaagatcgggtacagcctttctatgactaccccttcaatgtaggcaacagcctcaagcccaagaaaggacgcttcctgagcaaagaaaagcgagccgaagagtgggagagcggtaaggagcggttccgagaccttgaggcttggtcgcacagtgctgctcgtcggatagaggatgcttttgtcggaatcgagtatgcaagttgggaaaataagaagaaaatcgagcagctgttgcaggatctctccctttgggaaacctttgagagcaagctgaaagtcaaggcagacaagataaatattgccaaactgaaaaaggaaatactcgaagccaaagaacacccctatcacgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgacgtccaagagcaggggagcctcaatgtgctgaaccacgtgaagccgatgcgcttgcccgtggtcgtgtacagagccgacagccgaggccatgtacacaaggaggaggctcctctggcgacggtctatatcgaagaaagggacaccaagctgctgaagcagggcaatttcaaatccttcgtcaaggatcgccggctcaacggccttttctctttcgtcgataccggcgcactcgcgatggagcagtacccgatcagcaagctcagggtggagtacgagctggctaagtatcagacggcaagggtctgtgccttcgagcagacgctggagctggaagagagcctgctgacccgatatcctcacttgccggatgagagcttcagagagatgctcgaaagctggtcggatcctctcttggacaagtggccggatctgcaaagggaagtccggcttctgatcgctgtgcgcaatgccttctcgcacaatcagtatcccatgtacgatgagaccatcttttcgtccatccggaagtacgacccctcttccctcgatgccatagaggaaaggatggggctgaacatcgcgcaccggttgagcgaggaagtgaagctggcaaaagaaatggtagaacgaatcatacaagcataa

SEQ ID NO: 11086 - RNA, 3360 nt, synthetic construct
  misc_feature 1..3360: note = Cas13b variant__Porphyromonas gulae__WP_039437199.1__Cas13b
  source 1..3360: mol_type = other RNA
atgacagaacaaagcgagagaccgtacaacggtacctactacacactggaggacaaacatttctgggcagcctttctcaatctggcacgtcacaatgcctacatcaccctcactcacatcgacaggcagctcgcctacagcaaggccgatataaccaacgatgaggatatactcttcttcaagggccaatggaaaaacctcgacaacgatctggagaggaagtcacggctgagaagtttgatcctgaagcatttctcctttttggaaggagcggcatacggaaagaaattcttcgaaagcaaatcttccggaaacaaatcctccaagaataaagaactgacaaaaaaagaaaaggaggaactgcaagccaatgcactctccttggacaatctgaagagcatcctgttcgactttctgcaaaagctcaaggatttcaggaattactattcccactaccgacattccggatcttcggaattgcccctgttcgatggaaacatgcttcagagactgtacaacgtcttcgatgtgagtgtccaacgggtgaaaagagatcacgagcacaacgacgaggtcgatccccactaccacttcaaccatcttgtcaggaaaggcaagaaggacagatacggccataatgacaatccctccttcaagcaccattttgtcgatggagaggggatggtcacggaagccggactgctgtttttcgtctccctctttcttgagaaaagggatgccatctggatgcaaaagaagatccgaggcttcaagggcggcaccgaaccctacgaacagatgaccaacgaagtcttctgccggagccggatctccctgccgaaactcaaactggagagcctgcgcacggacgactggatgctgcttgatatgctgaacgaactggttcgctgtcccaagccgttgtacgatcgtcttcgcgaaaaggatagagcgtgtttcagagtgcccgttgatattctgcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggcgagcagccggaagaccgccatctgacgcgcaacctgtacggcttcggccgaatacaggatttcgccgaggagcatagacccgaagaatggaagcgtttggtgcgggatttggactacttcgagaccggcgacaagccctatatctcccaaaccactccgcactatcatatcgagaaaggaaagatcgggctgaggttcgtgccggaagggcagcatctttggccgtcgccggaggtaggaacgacccgaacggggcgaagcaaatacgcccaagacaaacggctcacggcagaagcattcctgagcgtgcatgagctgatgcccatgatgttctactacttcctgctgagggagaagtattccgaggaggtaagtgccgagaaggtgcaaggaagaatcaagagggtgatagaggatgtgtacgctatatacgatgctttcgcccgagacgaaatcaatacgctcaaggagttggatgcctgtttggcggacaagggtattcggcgaggacatctccccaagcaaatgatcggcatattgtcccaagagcgtaaggatatggaggagaaagtccgcaagaaacttcaggaaatgatagcggatacggatcaccgtctggatatgctggatcggcagaccgaccgaaagatcaggatcggccgaaagaatgccggcctgcccaagtcgggcgtcatagccgactggctggtacgggatatgatgcgctttcagcccgtggcgaaagacacgagcggcaagcccctgaacaatagcaaggccaacagcaccgaataccggatgctacagcgcgccctcgcccttttcggtggagagaaggaacgtctgaccccgtatttccgccagatgaatctgacgggagggaacaatccccatcctttcctgcacgagacccggtgggagagccataccaatatcctgtccttctatcgcagctatctgagagcaagaaaggctttcctcgaacgcatagggcgaagcgatcgggtggagaattgccccttcctcctgctcaaggaacccaaaaccgatcggcagacattggtggcaggctggaagggcgaatttcatctgccacgtggaatttttaccgaagcggtcagagactgcctgatagagatggggtacgatgaagtcgggtcatacagggaagtcggattcatggccaaagccgttccgctgtatttcgagcgggcttgtgaagaccgggtacagcctttctatgacagcccctttaatgtaggcaacagcctcaagcccaagaaaggacgcttcctgagcaaagaaaagcgtgccgaagagtgggagagcggtaaggagcggttccgactcgccaaactgaaaaaggaaatactcgaagcccaagaacacccctatcacgacttcaagtcgtggcagaagttcgagcgcgaactgcgccttgtcaagaatcaggatattatcacttggatgatgtgccgggatctcatggaagagaacaaggtggagggattggataccggtactctctacctgaaagatattcggcccaacgtccaagagcaggggagcctcaatgtgctgaaccgcgtgaagccgatgcgcttgcctgtggtcgtgtacagagccgacagccggggccatgtgcacaaggaggaggctcctctggcgacggtctatatcgaagagagagacaccaagctgctgaagcagggtaatttcaaatcctttgtcaaggatcgccggctcaacggccttttctctttcgtcgataccggcgcactcgcgatggagcagtacccgatcagcaagctcagggtggagtacgagctggccaagtatcagacggcaagggtctgtgccttcgagcagacgctggagctggaagagagcctgctgacccgatatcctcacttgccggatgagagcttcagagagatgctcgaaagctggtcggatcctctcttgaccaagtggccggagctgcacgggaaagtccggcttctgatcgctgtgcgcaatgccttctcgcacaatcagtatcccatgtacgatgaggccgtcttttcgtccatttggaagtacgacccctcttcccccgatgccatagaggaaaggatggggctgaacatcgcgcaccggttgagcgaggaagtgaagcaggcaaaagaaacgatagaacgaatcatacaagcataa

SEQ ID NO: 11087 - RNA, 3360 nt, synthetic construct
  misc_feature 1..3360: note = Cas13b variant__Porphyromonas gulae__WP_039419792.1__Cas13b
  source 1..3360: mol_type = other RNA
atgacagaacaaagcgagagaccgtacaacggtacctactacacactggaggacaaacatttctgggcagccttcctcaatctggcacgtcacaatgcctacatcaccctcacccatatcgacagacagctcgcctacagcaaggccgatataaccaacgatcaggatgtactctctttcaaagccctatggaaaaacctcgacaacgatctggagaggaagtcacggctgagaagtttgatcctgaagcatttctcctttttggaaggagcggcatacggaaagaaactcttcgaaagcaaatcttccggaaacaaatcctccaagaataaagaactgacaaaaaaagaaaaggaggagctgcaagccaatgcactctccttggacaatctgaagagcatcctgttcgactttctacaaaagctcaaggatttcagaaattactactcccactaccgacattccggatcttcggaattgcccctgttcgatggaaacatgcttcagagactgtacaacgtcttcgatgtgagtgtccaacgggtgaaaagagatcacgagcacaacgacaaggtcgatccccaccgccatttcaaccatcttgtcaggaaaggcaagaaggacagatacggccataacgacaatccctccttcaagcaccattttgtcgatggagaggggatggtcacggaagccggactgctgtttttcgtctccctctttcttgagaaaagggatgccatctggatgcaaaagaagatccgaggcttcaagggtggcaccgaaacctaccagcagatgaccaacgaagtcttctgccggagccggatctccttgccgaagctcaaactggagagcctgcgcacggacgactggatgctgctcgatatgctgaacgaactggttcgctgtcccaagccgttgtacgatcgtcttcgtgaaaaggatagagcgcgtttcagagtgcccgttgatattcttcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaaggtgatcggcgagcagccggaagaccgccatctgacgcgcaacctgtacggcttcggccgaatacaggatttcgccgaggagcatagacccgaagagtggaagcgtttggtgcgggatttggactacttcgagaccggcgacaagccctatatctcccaaaccactccgcactatcatatcgagaaaggcaagatcgggctgaggttcgtgccggaagggcagcatctttggccgtcgccggaggtaggaacgacccgaacggggcgaagcaaatacgcccaagacaaacggctcacggcagaagcattcctgagcgtgcatgagctgatgcccatgatgttctactacttcctgctgagggagaagtattccgaggaggtaagtgccgagaaggtgcaaggaaggatcaagagggtgatagaggatgtgtacgctatatacgatgctttcgcccgagacgaaatcaatacgcgcgacgagttggatgcctgtttggcggacaagggtattcggcgaggacatctccccaagcaaatgatcggcatattgtcccaagaacataagaatatggaggagaaagtccgcaagaaacttcaggaaatgatagcggatacggatcatcgtctggatatgctggatcggcagaccgaccgaaagatcaggatcggccgaaagaatgccggcctgcccaagtcgggcgtcatagccgactggctggtacgggatatgatgcgctttcagcccgtggcgaaagacacgagcggcaagcccctgaacaatagcaaggccaacagcaccgaataccggatgctacagcgcgccctcgcccttttcggtggagagaaggaacgtctgaccccgtatttccgccagatgaatctgacgggagggaacaatccccatcctttcctggacgagacccggtgggagagccataccaatatcctgtccttctatcgtagctatctgagagcaagaaaggctttcctcgaacgtatagggcgaagcgatcgggtggagaatcgccccttcctcctgctcaaggaacccaaaaccgatcgacagacattggtggcaggctggaagagcgaatttcatctgccacgcgggatttttaccgaagcggtcagagactgcctgatagagatggggtacgatgaagtcgggtcatacaaggaagtcggattcatggccaaagccgttccgctatatttcgagcgggcttgtaaagatcgggtacagcctttctatgactcccccttcaatgtaggcaacagcctcaagcccaagaaaggacgcttcctgagcaaagaaaagcgagccgaagagtgggagagcggtaaggagcggttccgactcgccaaactgaaaaaggaaatactcgaagcccaagaacacccctatcacgacttcaagtcgtggcagaagttcgagcgcgaactgcgacttgtcaagaatcaggatattatcacttggatgatgtgccgggatctcatggaagagaacaaggtggagggattggataccggtactctctacctgaaagatattcggcccaacgtccaagagcaggggagcctcaatgtgctgaaccgcgtgaagccgatgcgcttgcctgtggtcgtgtacagagccgacagccggggccatgtgcacaaggaggaggctcctctggcgacggtctatatcgaagagagggacaccaagctgctgaagcagggcaatttcaaatcctttgtcaaggatcgccggctcaacggccttttctctttcgtcgataccggcggactcgcgatggagcagtacccgatcagcaagctcagggtggagtacgagctggccaagtatcagacggcaagggtctgtgtcttcgagctgacgctcaggctggaagagagtctgctgagccggtatcctcacttgccggatgagagcttcagagagatgctcgaaagctggtcggatcctctcttggccaagtggccggagctgcacgggaaagtccggcttctgatcgctgtgcgcaatgccttctcgcacaatcagtatcccatgtacgatgaggccgtcttttcgtccattcggaagtacgacccctcttcccccgatgccatagaggaaaggatggggctgaacatcgcgcaccggttgagcgaggaagtgaagcaggcaaaagaaacggtagaacgaatcatacaagcataa

SEQ ID NO: 11088 - RNA, 3528 nt, synthetic construct
  misc_feature 1..3528: note = Cas13b variant__Porphyromonas gulae__WP_039431778.1__Cas13b
  source 1..3528: mol_type = other RNA
atgacagaacaaagcgagagaccgtacaacggtacctactacacactggaggacaaacatttctgggcagccttcctcaatctggcacgtcacaatgcctacatcaccctcactcatatcgacagacagctcgcctacagcaaggccgatataaccaacgatcaggatgtactctccttcaaagccctatggaaaaacttcgacaacgatctggagaggaagtcacggctgagaagtttgatcctgaagcatttctcctttttggaaggagcggcatacggaaagaaactcttcgaaagcaaatcttccggaaacaaatcctccaagaataaagaactgacaaaaaaagaaaaggaggagctgcaagccaatgcactctccttggacaatctgaagagcatcctgttcgactttctacaaaagctcaaggatttcaggaattactattcccactatcgacattccgaatcttcggaattgcccctgttcgatggaaacatgcttcagagactgtacaacgtcttcgatgtgagtgtccaacgggtgaaaagagatcacgagcacaacgacaaggtcgatccccaccgccatttcaaccaccttgtcaggaaaggcaagaaggacagatacggccataatgacaatccctccttcaagcaccattttgtcgatggagaggggatggtcacggaagccggactgctgtttttcgtctccctctttcttgagaaaagggatgccatctggatgcaaaagaagatccgaggcttcaagggtggcaccgaaacctaccagcagatgaccaacgaagtcttctgccggagccggatctccctgccgaagctcaaactggagagcctgcgcacggacgactggatgctgctcgatatgctgaacgaactggttcgctgtcccaagccgttgtacgatcgtcttcgcgaagacgatagagcgtgtttcagagtgcccgtcgatattctgcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggtgagcagccggaagaccgccatctgacgcgcaacctgtacggcttcggccgaatacaggatttcgccgaggagcatagacccgaagagtggaagcgtttggtgcgggatttggactacttcgagaccggcgacaagccctatatctcccaaacctctccgcactatcatatcgagaaaggcaagatcgggctgaggttcatgccggaagggcagcatctttggccgtcgccggaggtaggaacgacccgaacggggcgaagcaaatatgcccaagacaaacggctcacggcagaagccttcctgagcgtgcatgagctgatgcccatgatgttctactacttcctgctgagggagaagtattccgaggaggtaagtgccgagaaggtgcaaggaagaatcaagagggtgatagaggatgtgtacgctatatacgatgctttcgcccgagacgaaatcaatacgctcaaggagttggatgcctgtttggcggacaagggtattcggcgaggacatctccccaagcaaatgatcgccatattgtcccaagaacataaggatatggaggagaaaatccgcaagaaacttcaggaaatgatagcggatacggatcatcgtctggatatgctggatcggcagaccgaccgaaagatcaggatcggcagaaagaatgccggcctgcccaagtcgggcgtcatagccgactggctggtacgggatatgatgcgctttcagcccgtggcgaaagacacgagcggcaagcccctgaacaatagcaaggccaacagcaccgaataccggatgctacagcgcgccctcgcccttttcggtggagagaagaagcgtctgacgccgtatttccgccagatgaatctgacaggagggaacaatccccatcctttcctgcacgagacccggtgggagagccataccaatatcctgtccttctatcgcagctatctgagagcaagaaaggctttcctcgaacgcatagggcgaagcgatcggatggagaatcgccccttcctcctgctcaaggaacccaaaaccgatcgacagacattggtggcaggctggaagagcgaatttcatctgccacgcgggatttttaccgaagcggtcagagactgcctgatagagatggggtacgatgaagtcgggtcatacagggaagtcggattcatggccaaagccgttccgctgtatttcgagcgagcttgtgaagaccgtgtacagcctttctatgacagccccttcaatgtaggcaacagcctcaagcccaagaaaggacgcttcctgagcaaagaagagcgagccgaagagtgggagagaggtaaggagcggttccgagaccttgaggcttggtcgcacagtgctgctcgtcggatagaggatgcttttgccggaatcgagtatgcaagtccgggaaataagaagaaaatcgagcagctgttgcgggatctctccctttgggaagcctttgagagcaagctgaaagtcagggcagacaagatcaatctcgccaaactgaaaaaggaaatactcgaagcccaagaacacccctatcacgacttcaagtcgtggcagaagttcgagcgcgaactgcgccttgtcaagaatcaggatattatcacttggatgatgtgccgggatctcatggaagagaacaaggtggagggattggataccggtactctctacctgaaagatattcggcccaacgtccaagagcaggggagcctcaatgtgctgaaccgcgtgaagccgatgcgcttgcctgtggtcgtgtacagagccgacagccggggccatgtgcacaaggaggaggctcctctggcgacggtctatatcgaagagagagacaccaagctgctgaagcagggcaatttcaaatcctttgtcaaggatcgccggctcaacggtcttttctctttcgtcgataccggcggactcgcgatggagcagtacccgatcagcaagctcagggtggagtacgagctggccaagtatcagacggcaagggtctgtgtcttcgagctgacgctcaggctggaagagagtctgctgacccggtatcctcacttgccggatgagagcttcagaaagatgctcgaaagctggtcggatcctctcttggccaagtggccggagctgcacgggaaagtccggcttctgatcgctgtgcgcaatgccttctcgcacaatcagtatcccatgtacgatgaggccgtcttttcgtccattcggaagtacgacccctcttcccccgatgccatagaggaaaggatggggctgaacatcgcgcaccggttgagcgaggaagtgaagcaggcaaaagaaacggtagaacgaatcatacaagtataa

SEQ ID NO: 11089 - RNA, 3528 nt, synthetic construct
  misc_feature 1..3528: note = Cas13b variant__Porphyromonas gulae__WP_046201018.1__Cas13b
  source 1..3528: mol_type = other RNA
atgacagaacaaagcgagagaccgtacaacggtacctactacacactggaggacaaacatttctgggcagccttcctcaatctggcacgtcacaatgcctacatcaccctcactcatatcgacagacagctcgcctacagcaaggccgatataaccaacgatcaggatgtactctccttcaaagccctatggaaaaacttcgacaacgatctggagaggaagtcacggctgagaagtttgatcctgaagcatttctcctttttggaaggagcggcatacggaaagaaactcttcgaaagcaaatcttccggaaacaaatcctccaagaataaagaactgacaaaaaaagaaaaggaggagctgcaagccaatgcactctccttggacaatctgaagagcatcctgttcgactttctacaaaagctcaaggatttcaggaattactattcccactatcgacattccgaatcttcggaattgcccctgttcgatggaaacatgcttcagagactgtacaacgtcttcgatgtgagtgtccaacgggtgaaaagagatcacgagcacaacgacaaggtcgatccccaccgccatttcaaccaccttgtcaggaaaggcaagaaggacagatacggccataatgacaatccctccttcaagcaccattttgtcgatagtgaggggatggtcacggaagccggactgctgtttttcgtctccctctttcttgagaaaagggatgccatctggatgcaaaagaagatccgaggcttcaagggtggcaccgaaacctaccagcagatgaccaacgaagtcttctgccggagccggatctccttgccgaagctcaaactggagagcctgcgcacggacgactggatgctgctcgatatgctgaacgaactggttcgctgtcccaagccgttgtacgatcgtcttcgtgaaaaggatagagcgcgtttcagagtgcccgttgatattcttcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggcgagcagccggaagaccgccatctgacgcgcaacctgtacggcttcggccgaatacaggattttgccgaggagcatagacccgaagagtggaagcgtttggtgcgggatttggactacttcgagaccggcgacaagccctatatctcccaaaccactccgcactatcatatcgagaaaggcaagatcgggctgaggttcatgccggaagggcagcatctttggccgtcgccggaggtaggaacgacccgaacggggcgaagcaaatacgcccaagacaaacggctcacggcagaagcattcctgagcgtgcatgagctgatgcccatgatgttctactacttcctgctgagggagaagtattccgaggaggtaagtgccgagaaggtgcaaggaagaatcaagagggtgatagaggatgtgtacgctatatacgatgctttcgcccgagacgaaatcaatacgctcaaggagttggatgcctgtttggcggacaagggtattcggcgaggacatctccccaagcaaatgatcgccatattgtcccaagaacataaggatatggaggagaaaatccgcaagaaacttcaggaaatgatagcggatacggatcatcgtctggatatgctggatcggcagaccgaccgaaagatcaggatcggcagaaagaatgccggcctgcccaagtcgggcgtcatagccgactggctggtacgggatatgatgcgctttcagcccgtggcgaaagacacgagcggcaagcccctgaacaatagcaaggccaacagcaccgaataccggatgctacagcgcgccctcgcccttttcggtggagagaagaagcgtctgacgccgtatttccgccagatgaatctgacaggagggaacaatccccatcctttcctgcacgagacccggtgggagagccataccaatatcctgtccttctatcgcagctatctgagagcaagaaaggctttcctcgaacgcatagggcgaagcgatcggatggagaatcgccccttcctcctgctcaaggaacccaaaaccgatcgacagacattggtggcaggctggaagagcgaatttcatctgccacgcgggatttttaccgaagcggtcagagactgcctgatagagatggggtacgatgaagtcgggtcatacagggaagtcggattcatggccaaagccgttccgctgtatttcgagcgagcttgtgaagaccgtgtacagcctttctatgacagccccttcaatgtaggcaacagcctcaagcccaagaaaggacgcttcctgagcaaagaagagcgagccgaagagtgggagagaggtaaggagcggttccgagaccttgaggcttggtcgcacagtgctgctcgtcggatagaggatgcttttgccggaatcgagtatgcaagtccgggaaataagaagaaaatcgagcagctgttgcgggatctctccctttgggaagcctttgagagcaagctgaaagtcagggcagacaagatcaatctcgccaaactgaaaaaggaaatactcgaagcccaagaacacccctatcacgacttcaagtcgtggcagaagttcgagcgcgaactgcgccttgtcaagaatcaggatattatcacttggatgatgtgccgggatctcatggaagagaacaaggtggagggattggataccggtactctctacctgaaagatattcggcccaacgtccaagagcaggggagcctcaatgtgctgaaccgcgtgaagccgatgcgcttgcctgtggtcgtgtacagagccgacagccggggccatgtgcacaaggaggaggctcctctggcgacggtctatatcgaagagagagacaccaagctgctgaagcagggcaatttcaaatcctttgtcaaggatcgccggctcaacggtcttttctctttcgtcgataccggcggactcgcgatggagcagtacccgatcagcaagctcagggtggagtacgagctggccaagtatcagacggcaagggtctgtgtcttcgagctgacgctcaggctggaagagagtctgctgacccggtatcctcacttgccggatgagagcttcagaaagatgctcgaaagctggtcggatcctctcttggccaagtggccggagctgcacgggaaagtccggcttctgatcgctgtgcgcaatgccttctcgcacaatcagtatcccatgtacgatgaggccgtcttttcgtccattcggaagtacgacccctcttcccccgatgccatagaggaaaggatggggctgaacatcgcgcaccggttgagcgaggaagtgaagcaggcaaaagaaacggtagaacgaatcatacaagtataa

SEQ ID NO: 11090 - RNA, 3525 nt, synthetic construct
  misc_feature 1..3525: note = Cas13b variant__Porphyromonas gulae__WP_039442171.1__Cas13b
  source 1..3525: mol_type = other RNA
atgacagaacaaagcgagagaccgtacaacggtacctactacacactggaggacaaacatttctgggcagcctttctcaatctggcacgtcacaatgcctacatcaccctcactcatatcgacagacagctcgcctacagcaaggccgatataaccaacgatcaggatgtactctctttcaaagccctatggaaaaacctcgacaacgatctggagaggaagtcacggctgagaagtttgatcctgaagcatttctcctttttggaaggagcggcatacggaaagaaactcttcgaaagcaaatcttccggaaacaaatcctccaagaataaagaactgacaaaaaaagaaaaggaggagctgcaagccaatgcactctccttggacaatctgaagagcatcctgttcgactttctacaaaagctcaaggatttcagaaattactactcccactaccgacattccggatcttcggaattgcccctgttcgatggaaacatgcttcagagactgtacaacgtcttcgatgtgagtgtccaacgggtgaaaagagatcacgagcacaacgacaaggtcgatccccactaccacttcaaccatcttgtcaggaaaggcaagaaggacagatacggccataacgacaatccctccttcaagcaccattttgtcgatagtgaggggatggtcacggaagccggactgctgtttttcgtctccctctttcttgagaaaagggatgccatctggatgcaaaagaagatccgaggcttcaagggcggcaccggaccctacgagcagatgaccaacgaagtcttctgccggagccggatctccctgccgaaactcaaactggagagcctgcgcacggacgactggatgctgcttgatatgctgaacgaactggttcgctgtcccaagccgttgtacgatcgtcttcgcgaaaaggatagagcgtgtttcagagtgcccgttgatattctgcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggtgagcagccggaagaccgccatctgacgcgcaacctgtacggcttcggccgaatacaggatttcgccgaggagcatagacccgaagaatggaagcgtttggtgcgggatttggactacctcgagaccggcgacaagccctatatctcccaaactactccgcactatcatatcgagaaaggaaagatcgggctgaggttcgtgccggaagggcagcatctttggccgtcgccggaggtaggaacgacccgaacggggcgaagcaaatgtgcccaagacaaacggctcacggcagaagccttcctgagcgtgcatgagctgatgcccatgatgttctactacttcctgctgagggagaagtattccgaggaggtaagtgccgagaaggtgcaaggaagaatcaagagggtgatagaggatgtgtacgctatatacgatgctttcgcccgagacgaaatcaatacgctcaaggagttggatacctgtttggcagacaagggtattcggcgaggacatctcccgaagcaaatgatcaccatattgtcccaagagcgtaaggatatgaaggagaaaatccgcaagaaacttcaggaaatgatagcggatacggatcatcgtctggatatgctggatcggcagaccgaccgaaagatcaggatcggccgaaagaatgccggcctgcccaagtcgggcgtcatagccgactggctggtacgggatatgatgcgctttcagcccgtggcgaaagacgcaagcggcaagcccctgaacaatagcaaggccaacagcaccgaataccggatgctacagcgcgccctcgcccttttcggtggagagaaggaacgtctgacaccgtatttccgtcagatgaatctgacgggagggaacaatccccatcctttcctgcacgagacccggtgggagagccataccaatatcctgtccttctatcgcagctatctgagagcaagaaaggctttcctcgaacgcatagggcgaagcgatcgggtggagaattgccccttcctcctgctcaaggaacccaaaaccgatcggcagacattggtggcaggctggaaggacgaatttcatctgccacgcgggatttttaccgaagcggtcagagactgcctgatagagatggggtacgatgaagtcgggtcatacagggaagtcggattcatggccaaagccgttccgctgtatttcgagcgggcttgtgaagaccgggtacagcctttctatgacagccccttcaatgtaggcaacagcctcaagcccaagaaaggacgcttcctgagcaaagaagaccgagccgaagagtgggagagaggtatggagcggttccgagaccttgaggcttggtcgcacagtgctgctcgtcggataaaagatgcttttgccggaatcgagtatgcaagtccgggaaataagaagaaaatcgaacagctgttgcgggatctctccctttgggaagcctttgagagcaagctgaaagtcagggcagacaagatcaatctcgccaaactgaaaaaggaaatactcgaagcccaagaacacccctatcacgacttcaagtcgtggcagaagttcgagcgcgaactgcgacttgtcaagaatcaggatattatcacttggatgatgtgccgggatctcatggaagagaacaaggtggagggattggataccggtactctctacctgaaagatattcggcccaacgtccaagagcaggggagcctcaatgtgctgaaccgcgtgaagccgatgcgcttgcctgtggtcgtgtacagagccgacagccggggccatgtgcacaaggaggctcctctggcgacggtctatatcgaagagaggaacaccaagctgctgaagcagggcaatttcaaatcctttgtcaaggatcgccggctcaacggccttttctctttcgtcgataccggcggactcgcgatggagcagtacccgatcagcaagctcagggtggagtacgagctggccaagtatcagacggcaagggtctgtgtcttcgagctgacgctcaggctggaagagagtctgctgagccggtatcctcacttgccggatgagagcttcagagagatgctcgaaagctggtcggatcctctcttggccaagtggccggagctgcacgggaaagtccggcttctgatcgctgtgcgcaatgccttctcgcacaatcagtatcccatgtacgatgaggccgtcttttcgtccattcggaagtacgacccctcttcccccgatgccatagaggaaaggatggggctgaacatcgcgcaccggttgagcgaggaagtgaagcaggcaaaagaaacggtagaacgaatcatacaagcataa

SEQ ID NO: 11091 - RNA, 3360 nt, synthetic construct
  misc_feature 1..3360: note = Cas13b variant__Porphyromonas gulae__WP_039426176.1__Cas13b
  source 1..3360: mol_type = other RNA
atgacagaacaaagcgagagaccgtacaacggtacctactacacactggaggacaaacatttctgggcagccttcctcaatctggcacgtcacaatgcctacatcaccctcacccatatcgacagacagctcgcctacagcaaggccgatataaccaacgatcaggatgtactctccttcaaagccctatggaaaaacttcgacaatgatctggagaggaagtcacggctgagaagtttgatcctgaagcatttctcctttttggaaggagcggcatacggaaagaaactcttcgaaagcaaatcttccggaaacaaatcctccaagaataaagaactgacgaaaaaagaaaaggaggagctgcaagccaatgcgctctccttggacaatctgaagagcatcctgttcgactttctacaaaagctcaaggatttcagaaattactactcccactaccgacattccggatcttcggaattgcccctgttcgatggaaacatgcttcagagactgtacaacgtcttcgatgtgagtgtccaacgggtgaaaagagatcacgagcacaacgacaaggtcgatccccactaccacttcaaccatcttgtcaggaaaggcaagaaggacagatacggccataacgacaatccctccttcaagcaccattttgtcgatagtgaggggatggtcacggaagccggactgctgtttttcgtctccctctttcttgagaaaagggatgccatctggatgcaaaagaagatccgaggcttcaagggcggcaccggaccctacgagcagatgaccaacgaagtcttctgccggagccggatctccctgccgaaactcaaactggagagcctgcgcacggacgactggatgctgcttgatatgctgaacgaactggttcgctgtcccaagccgttgtacgatcgtcttcgcgaaaaggatagagcgtgtttcagagtgcccgttgatattctgcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggtgagcagccggaagaccgccatctgacgcgcaacctgtacggcttcggccgaatacaggatttcgccgaggagcatagacccgaagagtggaagcgtttggtgcgggatttggactacttcgagaccggcgacaagccctatatctcccaaaccactccgcactatcatatcgagaaaggcaagatcgggctgaggttcatgccggaagggcagcatctttggccgtcgccggaggtaggaacgacccgaacggggcgaagcaaatacgcccaagacaaacggctcacggcagaagccttcctgagcgtgcatgagctgatgcccatgatgttctactacttcctgctgagggagaagtattccgaggaggtaagtgccgagaaggtgcaaggaagaatcaagagggtgataaaggatgtgtacgctatatacgatgctttcgcccgagacgaaatcaatacgctcaaggagttggatgcctgttcggcggacaagggtattcggcgaggacatctccccaagcaaatgatcggcatattgtcccaagaacataagaatatggaggagaaagtccgcaagaaacttcaggaaatgatagcggatacggatcatcgtctggatatgctggatcggcagaccgaccgaaagatcaggatcggcagaaagaatgccggcctgcccaagtcgggcgtcatagccgactggctggtacgggatatgatgcgctttcagcccgtggcgaaagacacgagcggcaagcccctgaacaatagcaaggccaacagcaccgaataccggatgctacagcgcgccctcgcccttttcggtggagagaaggaacgtctgaccccgtatttccgccagatgaatctgacgggagggaacaatccccatcctttcctggacgagacccggtgggagagccataccaatatcctgtccttctatcgtagctatctgagagcaagaaaggctttcctcgaacgtatagggcgaagcgatcgggtggagaatcgccccttcctcctgctcaaggaacccaaaaacgatcggcagacattagtggccggctggaagagcgaatttcatctgccacgcgggatttttaccgaagcggtcagagactgcctgatagagatggggtacgatgaagtcgggtcatacaaggaagtcggattcatggccaaagccgttccgctatatttcgagcgggcttgtaaagatcgggtacagcctttctatgactcccccttcaatgtaggcaacagcctcaagcccaagaaaggacgcttcctgagcaaagaaaagcgagccgaagagtgggagagcggtaaggagcggttccgactcgccaaactgaaaaaggaaatactcgaagccaaagaacacccctatcacgacttcaagtcgtggcagaagttcgagcgcgaactgcgccttgtcaagaatcaggatattatcacttggatgatgtgcagggatctcatggaagagaacaaggtggagggattggataccggtactctctacctgaaagatattcggaccgacgtccatgagcaggggagcctcaatgtgctgaaccgcgtgaagccgatgcgcttgcccgtggtcgtgtacagagccgacagccggggccatgtacacaaggagcaggctcctctggcgacggtctatatcgaagaaagggacaccaagctgctgaagcagggcaatttcaaatcctttgtcaaggatcgccggctcaacggccttttctctttcgtcgataccggcggactcgcgatggagcagtacccgatcagcaagctcagggtggagtacgagctggccaagtatcagacggcaagggtctgtgccttcgagcagacgctggagctggaagagagcctgctgacccgatatcctcacttgccggatgagaacttcagagagatgctcgaaagctggtcggatcctctcttgggcaagtggccggatctgcacgggaaagtccggcttctgatcgctgtgcgcaatgccttctcgcacaatcagtatcccatgtacgacgaggccgtcttttcgtccatccggaagtacgacccctcttcccccgatgccatagaagaaaggatgggactgaacatcgcgcaccggttgagcgaggaagtgaagcaggcaaaagaaacggtagaacgaatcatacaagcataa

SEQ ID NO: 11092 - RNA, 3528 nt, synthetic construct
  misc_feature 1..3528: note = Cas13b variant__Porphyromonas gulae__WP_039418912.1__Cas13b
  source 1..3528: mol_type = other RNA
atgacagaacaaagcgagagaccgtacaacggtacctactacacactggaggacaaacatttctgggcagccttcctcaatctggcacgtcacaatgcctacatcaccctcacccatatcgacagacagctcgcatacagcaaggccgatataaccaacgatcaggatgtactctccttcaaagccctatggaaaaacctcgacaacgatctggaaaggaagtcacggctgagaagtttgatcctgaagcatttctcctttttggaaggagcggcatacggaaagaaactcttcgaaagcaaatcttccggaaacaaatcctccaagaataaagaactgacaaaaaaagaaaaggaggagctgcaagccaatgcgctctccttggacaatctgaagagcatcctgttcgactttctacaaaagctcaaggatttcagaaattactactcccactaccgacattccggatcttcggaattgcccctgttcgatggaaacatgcttcagagactgtacaacgtcttcgatgtgagtgtccaacgggtgaaaagagatcacgagcacaacgacaaggtcgatccccaccgccatttcaaccaccttgtcaggaaaggcaagaaggacagatacggccataatgacaatccctccttcaagcaccattttgtcgatagtgaggggatggtcacggaagccggactgctgtttttcgtctccctctttcttgagaaaagggatgccatctggatgcaaaagaagatccgaggcttcaagggtggcaccgaaacctaccagcagatgaccaacgaagtcttctgccggagccggatctccctgccgaaactcaaactggagagcctgcgcatggacgactggatgctgcttgatatgctgaacgaactggttcgctgtcccaagccgttgtacgatcgtcttcgcgaagacgatagagcgtgtttcagagtgcccgtcgatattctgcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggtgagcagccggaagaccgccatctgacgcgcaacctgtacggcttcggccgaatacaggatttcgccgaggagcatagacccgaagagtggaagcgtttggtgcgggatttggactacttcgagaccggcgacaagccctatatctcccaaacctctccgcactatcatatcgagaaaggcaagatcgggctgaggttcatgccggaagggcagcatctttggccgtcgccggaggtaggaacgacccgaacggggcgaagcaaatatgcccaagacaaacggctcacggcagaagccttcctgagcgtgcatgagctgatgcccatgatgttctactacttcctgctgagggagaagtattccgaggaggtaagtgccgagaaggtgcaaggaagaatcaagagggtgatagaggatgtgtacgctatatacgatgctttcgcccgagacgaaatcaatacgctcaaggagttggatgcctgtttggcggacaagggtattcggcgaggacatctccccaagcaaatgatcgccatattgtcccaagaacataagaatatggaggagaaagtccgcaagaaacttcaggaaatgatagcggatacggatcatcgtctggatatgctggatcggcagaccgaccgaaagatcaggatcggccgaaagaatgccggcctgcccaagtcgggcgtcatagccgactggctggtacgggatatgatgcgctttcagcccgtggcgaaagacgcaagcggcaagcccctgaacaatagcaaggccaacagcaccgaataccggatgctacagcgcgccctcgcccttttcggtggagagaaggagcgtctgaccccgtatttccgccagatgaatctgacgggagggaacaatccccatcctttcctgcacgatacccggtgggagagccataccaatatcctgtctttctatcgcagctatctgagagcaagaaaggctttcctcgaacgcatagggcgaagcgatcggatggagaatcgccccttcctcctgctcaaggaacccaaaaccgatcgacagacattggtggcaggctggaagagcgaatttcatctgccacgcgggatttttaccgaagcggtcagagactgcctgatagagatggggtacgatgaagtcgggtcatacagggaagtcggattcatggccaaagccgttccgctgtatttcgagcgagcttgtgaagaccgtgtacagcctttctatgacagccccttcaatgtaggcaacagcctcaagcccaagaaaggacgcttcctgagcaaagaagagcgagccgaagagtgggagagaggtaaggagcggttccgagaccttgaggcttggtcgcacagtgctgctcgtcggatagaggatgcttttgccggaatcgagtatgcaagtccgggaaataagaagaaaatcgagcagctgttgcgggatctctccctttgggaagcctttgagagcaagctgaaagtcagggcagacaagatcaatctcgccaaactgaaaaaggaaatactcgaagcccaagaacacccctatcacgacttcaagtcgtggcagaagttcgagcgcgaactgcgccttgtcaagaatcaggatattatcacttggatgatgtgccgggatctcatggaagagaacaaggtggagggattggataccggtactctctacctgaaagatattcggaccaacgtccaagagcagggaagcctcaatgtgctgaaccacgtgaagccgatgcgcttgcccgtggtcgtgtacagagccgacagccgaggccatgtacacaaggaggaggctcctctggcgacggtctatatcgaagaaagggacaccaagctgctgaagcagggtaatttcaaatccttcgtcaaggatcgccggctcaacggccttttctctttcgtcgataccggcggactcgcgatggagcagtacccgatcagcaagctcagggtggagtacgagctggccaagtatcagacggcaagggtctgtgccttcgagcagacgctggagctggaagagagcctgctgacccgatatcctcacttgccggataagaacttcagaaagatgctcgaaagctggtcggatcctctcttggccaagtggccggagctgcacgggaaagtccggcttctgatcgctgtgcgcaatgccttctcgcacaatcagtatcccatgtacgatgaggccgtcttttcgtccattcggaagtacgacccctcttcccccgatgccatagaggaaaggatggggctgaacatcgcgcaccggttgagcgaggaagtgaagcaggcaaaagaaacggtagaacgaatcatacaagcataa

SEQ ID NO: 11093 - RNA, 3528 nt, synthetic construct
  misc_feature 1..3528: note = Cas13b variant__Porphyromonas gulae__WP_039434803.1__Cas13b
  source 1..3528: mol_type = other RNA
atgacagaacaaagcgagagaccgtacaacggtacctactacacactggaggacaaacatttctgggcagccttcctcaatctggcacgtcacaatgcctacatcaccctcactcatatcgacagacagctcgcctacagcaaggccgatataaccaacgatcaggatgtactctccttcaaagccctatggaaaaacttcgacaacgatctggagaggaagtcacggctgagaagtttgatcctgaagcatttctcctttttggaaggagcggcatacggaaagaaactcttcgaaagcaaatcttccggaaacaaatcctccaagaataaagaactgacaaaaaaagaaaaggaggagctgcaagccaatgcactctccttggacaatctgaagagcatcctgttcgactttctgcaaaagctcaaggatttcaggaattactattcccactaccgacattccggatcttcggaattgcccctgttcgatggaaacatgcttcagagactgtacaacgtcttcgatgtgagtgtccaacgggtgaaaatagatcacgagcacaacgacgaggtcgatccccactaccacttcaaccatcttgtcaggaaaggcaagaaggacagatacggccataatgacaatccctccttcaagcaccattttgtcgatggagaggggatggtcacggaagccggactgctgtttttcgtctccctctttcttgagaaaagggatgccatctggatgcaaaagaagatccgaggcttcaagggtggcaccgaaacctaccagcagatgaccaacgaagtcttctgccggagccggatctccctgccgaaactcaaactggagagcctgcgcatggacgactggatgctgcttgatatgctgaacgaactggttcgctgtcccaagccgttgtacgatcgtcttcgcgaagacgatagagcgtgtttcagagtgcccgtcgatattctgcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggtgagcagccggaagaccgccatctgacgcgcaacctgtacggcttcggccgaatacaggatttcgccgaggagcatagacccgaagagtggaagcgtttggtgcgggatttggactacttcgagaccggcgacaagccctatatctcccaaacctctccgcactatcatatcgagaaaggcaagatcgggctgaggttcatgccggaagggcagcatctttggccgtcgccggaggtaggaacgacccgaacggggcgaagcaaatatgcccaagacaaacggctcacggcagaagccttcctgagcgtgcatgagctgatgcccatgatgttctactacttcctgctgagggagaagtattccgaggaggtaagtgccgagagggtgcaaggaagaataaagagggtgatagaggatgtgtacgctgtctacgatgctttcgcccgagacgaaatcaatacgcgcgacgagttggatgcctgtttggcggacaagggtattcggcgaggacatctccccaggcaaatgatcgccatattgtcccaagagcataaggatatggaggagaaaatccgcaagaaacttcaggaaatgatggcggatacggatcatcgtctggatatgctggatcggcagaccgaccgaaagatcaggatcggccgaaagaatgccggcctgcccaagtcgggcgtcatagccgactggctggtacgggatatgatgcgctttcagcccgtggcgaaagacgcaagcggcaagcccctgaacaatagcaaggccaacagcaccgaataccggatgctacagcgcgccctcgcccttttcggtggagagaaggaacgtctgacaccgtatttccgtcagatgaatctgacgggagggaacaatccccatcctttcctgcacgagacccggtgggagagccataccaatatcctgtccttctatcgcagctatctgagagcaagaaaggctttcctcgaacgcatagggcgaagcgatcgggtggagaatcgccccttcctcctgctcaaggaacccaaaaccgatcggcagacattggtggcaggctggaagggcgaatttcatctgccacgcgggatttttaccgaagcggtcagagactgcctgatagagatggggcacgatgaagttgcgtcatacaaggaagtcggattcatggccaaagccgttccgctgtatttcgagcgagcttgtgaagaccgtgtacagcctttctatgacagccccttcaatgtaggcaacagcctcaagcccaagaaaggacgcttcctgagcaaagaagagcgagccgaagagtgggagagaggtaaggagcggttccgagaccttgaggcttggtcgtacagtgctgctcgtcggatagaggatgcttttgctggaatcgagtatgcaagtccgggaaataagaagaaaatcgagcagctgttgcgggatctctccctttgggaagcctttgagagcaagctgaaagtcagggcagacaggatcaatctcgccaaactgaaaaaggaaatactcgaagcccaagaacacccctatcacgacttcaagtcgtggcagaagttcgagcgcgaactgcgccttgtcaagaatcaggatattatcacttggatgatgtgccgggatctcatggaagagaacaaggtggagggattggataccggtactctctacctgaaagatattcggcccaacgtccaagagcaggggagcctcaatgtgctgaaccgcgtgaagccgatgcgcttgcctgtggtcgtgtacagagccgacagccggggccatgtgcacaaggaggaggctcctctggcgacggtctatatcgaagagagggacaccaagctgctgaagcagggcaatttcaaatcctttgtcaaggatcgccggctcaacggccttttctctttcgtcgataccggcggactcgcgatggagcagtacccgatcagcaagctcagggtggagtacgagctggccaagtatcagacggcaagggtctgtgtcttcgagctgacgctcaggctggaagagagtctgctgacccggtatcctcacttgccggatgagagcttcagagagatgctcgaaagctggtcggatcctctcttggccaagtggccggagctgcacgggaaagtccggcttctgatcgctgtgcgcaatgccttctcgcacaatcagtatcccatgtacgatgaggccgtcttttcgtccattcggaagtacgacccctcttcccccgatgccatagaggaaaggatggggctgaacatcgcgcaccggttgagcgaggaagtgaagcaggcaaaagaaacggtagaacgaatcatacaagcataa

SEQ ID NO: 11094 - RNA, 3528 nt, synthetic construct
  misc_feature 1..3528: note = Cas13b variant__Porphyromonas sp.__WP_039428968.1__Cas13b
  source 1..3528: mol_type = other RNA
atgacagaacaaagcgagagaccgtacaacggtacctactacacactggaggacaaacatttctgggcagccttcctcaatctggcacgtcacaatgcctacatcaccctcacccatatcgacagacagctcgcctacagcaaggccgatataaccaacgatcaggatgtactctccttcaaagccctatggaaaaacttcgacaatgatctggagaggaagtcacggctgagaagtttgatcctgaagcatttctcctttttggaaggagcggcatacggaaagaaactcttcgaaagcaaatcttctggaaacaaatcctccaagaataaagaactgacaaaaaaagaaaaggaggagctgcaagccaatgcactctccttggacaatctgaagagcatcctgttcgactttctacaaaagctcaaggatttcaggaattactattcccactatcgacattccgaatcttcggaattgcccctgttcgatggaaacatgcttcagagactgtacaacgtcttcgatgtgagtgtccaacgggtgaaaagagatcacgagcacaacgacaaggtcgatccccaccgccatttcaaccaccttgtcaggaaaggcaagaaggacagatacggccataatgacaatccctccttcaagcaccattttgtcgatagtgaggggatggtcacggaagccggactgctgtttttcgtctccctctttcttgagaaaagggatgccatctggatgcaaaagaagatccgaggcttcaagggtggcaccgaaacctaccagcagatgaccaacgaagtcttctgccggagccggatctccctgccgaagctcaaactggagagcctgcgcacggacgactggatgctgctcgatatgctgaacgaactggttcgctgtcccaagccgttgtacgatcgtcttcgcgaagacgatagagcgtgtttcagagtgcccgtcgatattctgcccgatgaggacgatacggacggtgggggagaagaccccttcaaaaacacgctggtcaggcatcaggatcgcttcccctacttcgccttgcgatacttcgatctgaagaaagtcttcacttccctccgcttccatatagatttgggcacctaccacttcgccatatacaagaagatgatcggcgagcagccggaagaccgccatctgacgcgcaacctgtacggcttcggccgaatacaggatttcgccgaggagcatagacccgaagagtggaagcgtttggtgcgggatttggactacttcgagaccggcgacaagccctatatctcccaaaccactccgcactatcatatcgagaaaggcaagatcgggctgaggttcgtgccggaagggcagcatctttggccgtcgccggaggtaggaacgacccgaacggggcgaagcaaatacgcccaagacaaacggctcacggcagaagcattcctgagcgtgcatgagctgatgcccatgatgttctactacttcctgctgagggagaagtattccgaggaggtaagtgccgagaaggtgcaaggaagaatcaagagggtgatagaggatgtgtacgctatatacgatgctttcgcccgagacgaaatcaatacgctcaaggagttggatgcctgtttggcggacaagggtattcggcgaggacatctccccaagcaaatgatcggcatattgtcccaagagcgtaaggatatggaggagaaagtccgcaagaaacttcaggaaatgatagcggatacggatcaccgtctggatatgctggatcggcagaccgaccgaaagatcaggatcggccgaaagaatgctggcctgcccaagtcgggcgtcatagccgactggctggtacgggatatgatgcgctttcagcccgtggcgaaagacacgagcggcaagcccctgaacaatagcaaggccaacagcaccgaataccggatgctacagcgcgccctcgcccttttcggtggagagaaggaacgtctgaccccgtatttccgccagatgaatctgacgggagggaacaatccccatcctttcctgcacgagacccggtgggagagccataccaatatcctgtccttctatcgcagctatctgagagcaagaaaggctttcctcgaacgcatagggcgaagcgatcgggtggagaattgccccttcctcctgctcaaggaacccaaaactgatcggcagacattggtggcaggctggaagggcgaatttcatctgccacgcgggatttttaccgaagcggtcagagactgcctgatagagatggggtacgatgaagtcgggtcatacagggaagtcggattcatggccaaagccgttccgctgtatttcgagcgggcttgtgaagaccgggtacagcctttctatgacagccccttcaatgtaggcaacagcctcaagcccaagaaaggacgcttcctgagcaaagaagaccgagccgaagagtgggagagaggtaaggagcggttccgagaccttgaggcttggtcgcacagtgctgctcgtcggataaaagatgcttttgccggaatcgagtatgcaagtccgggaaataagaagaaaatcgaacagctgttgcgggatctctccctttgggaagcctttgagagcaagctgaaagtcagggcagacaagatcaatctcgccaaactgaaaaaggaaatactcgaagcccaagaacacccctatcacgacttcaagtcgtggcagaagttcgagcgcgaactgcgacttgtcaagaatcaggatattatcacttggatgatgtgccgggatctcatggaagagaacaaggtggagggattggataccggtactctctacctgaaagatattcggcccaacgtccaagagcaggggagcctcaatgtgctgaaccgcgtgaagccgatgcgcttgcctgtggtcgtgtacagagccgacagccggggccatgtgcacaaggaggaggctcctctggcgacggtctatatcgaagagagggacaccaagctgctgaagcagggcaatttcaaatcctttgtcaaggatcgccggctcaacggccttttctctttcgtcgataccggcggactcgcgatggagcagtacccgatcagcaagctcagggtggagtacgagctggccaagtatcagacggcaagggtctgtgtcttcgagctgacgctcaggctggaagagagtctgctgagccggtatcctcacttgccggatgagagcttcagagagatgctcgaaagctggtcggatcctctcttggccaagtggccggagctgcacgggaaagtccggcttctgatcgctgtgcgcaatgccttctcgcacaatcagtatcccatgtacgatgaggccgtcttttcgtccattcggaagtacgacccctcttcccccgatgccatagaggaaaggatggggctgaacatcgcgcaccggttgagcgaggaagtgaagcaggcaaaagaaacggtagaacgaatcatacaagcataa

SEQ ID NO: 11095 - RNA, 3375 nt, synthetic construct
  misc_feature 1..3375: note = Cas13b variant__Prevotella aurantiaca__WP_025000926.1__Cas13b
  source 1..3375: mol_type = other RNA
atggaagacgacaagaaaaccacaggctcaattagctacgagttaaaagataagcatttttgggcggcgttccttaatttggcacgccacaatgtctatattacaatcaaccatattaacaagctactggaaatacgagaaatcgacaatgacgagaaggtattagatatcaaaactctttggcaaaaaggtaataaagaccttaatcagaaagctcggttaagagaactgatgacaaaacacttcccattcttggaaactgcaatatacaccaaaaacaaagaagataagaaagaagtaaaacaagaaaaacaagccgaagcacaatcacttgaaagcctaaaggattgtttattcctctttttagacaagcttcaagaagcaagaaactattattctcattacaagtattctgaattttcaaaagagccagagtttgaggaaggattattggaaaagatgtataatatctttggcaacaatatccagttagtgataaatgattaccaacataacaaagatattaaccctgacgaagactttaaacatcttgacagaaaaggacaattcaaatactcttttgcagataacgaaggaaacataactgaaagcggtttgctcttctttgtttccttattccttgaaaagaaagatgcaatatggatgcagcaaaagcttaatggctttaaagacaatctagaaaacaaaaagaaaatgacccacgaggtattttgcagaagccgaatactcatgccaaaacttcgattggaaagcacgcaaacacaagattggattttgctcgatatgctcaacgaactgattcgttgccctaaatcgttgtatgaacgcctgcaaggagatgacagagaaaagttcaaagtccccttcgaccccgcagacgaggactacaatgcagagcaagagcctttcaaaaacacattgataaggcaccaagatcgtttcccttactttgtattgcgttatttcgactataacgagatattcaaaaatcttcgtttccaaatagatttaggcacctatcacttctctatttataagaaactaattggtggtcaaaaagaagaccgccaccttacgcataaactttatggttttgaacgcatacaagagttcgccaaacagaatcgccccgatgaatggaaagcaatcgtaaaagacttagatacttacgaaacttcaaacaaacgatatatctcggaaaccacaccccattatcatttggagaaccaaaagattggcattaggtttaggaatggtaacaaggaaatttggccatcgctcaaaacaaatgacgaaaataatgaaaaaagcaagtataaacttgataagcaataccaagcagaagctttcttgagcgtacacgaacttttgccaatgatgttctactatctgttgttaaagaaggaaaagcctaataatgacgagataaacgcaagtatagtagaaggctttatcaaaagagaaatcagaaatatatttaaactctatgatgcttttgccaatggtgagataaacaacatagacgatttagaaaaatactgtgcggacaaaggaatccccaaaagacatctgcccaaacagatggttgccattttgtacgacgagcataaagatatggtaaaagaggcgaaacgcaagcaaaaggaaatggtaaaggataccaagaaactgcttgctactcttgaaaaacaaacacaaaaagaaaaagaagatgacggaagaaatgtaaaactcttgaaatctggcgagattgccagatggctggtaaatgatatgatgcgctttcagcctgttcaaaaagacaatgagggtaaaccacttaacaatagtaaagccaacagcacagaatatcaaatgctgcaacgctcccttgcgctttataataatgaagaaaaacccactcgttacttcagacaagttaatctcatagaaagtaacaatccccaccctttcttaaaatggacgaagtgggaagaatgtaataatatcttaacattctattatagttatctgacaaaaaagatagaatttctaaataagctaaagcctgaagattggaagaagaaccaatatttccttaagcttaaagagccaaagaccaaccgagaaacattggtgcaagggtggaagaatggctttaatctgccacgtggtatctttacagaacctatcagagaatggtttaaaaggcatcagaacaattctaaggaatacgagaaagtcgaagccctcgacagagtcggcttggttacaaaggtaatacccttgttcttcaaagaagaatattttaaagacaaagaagaaaattttaaagaagatacccaaaaagaaattaacgactgcgtacagccattttacaactttccttacaatgtgggcaatatacacaaacccaaagaaaaggatttcttacatcgtgaggaacgtatagaactgtgggataaaaagaaagacaagttcaagggttataaagaaaaaataaagtccaagaagttgacggaaaaggataaagaagaatttcgttcttatcttgaatttcaatcttggaataagttcgagcgagaattacgacttgtacgaaaccaagacatcgtaacgtggctgttgtgtaaggaactgattgataaactgaaaatagacgaactcaatattgaagaattgaaaaagctacgcttaaataatattgatacagacacagcaaaaaaggaaaagaacaatattctgaacagagtaatgccgatggaactacctgttacggtgtacgaaattgacgattcccacaaaatagtaaaggataaacctttgcataccatttatataaaagaggctgaaaccaagcttttaaaacaaggaaacttcaaagctttggtaaaagaccgcagacttaatggtttattctcgttcgttaaaactaactctgaagcagaatcgaagagaaatcctatcagtaagttacgtgtagaatatgaactcggagaatatcaagaagcaagaatagaaattatccaagatatgttggcgttagaagaaaagctgataaataaatataaagatttgccaaccaacaagttcagtgaaatgcttaatagttggttggagggtaaagacgaggcagacaaagcaaggtttcaaaatgatgtagactttcttattgctgtacgaaatgccttttcacacaaccaatacccaatgcacaacaaaatagaattcgcaaatattaagccattcagtctttatacagcgaataattcggaagaaaaaggacttggtattgccaatcagctaaaggataaaaccaaagaaacaacagacaaaataaaaaaaatagaaaagccaatagaaactaaagaataa

SEQ ID NO: 11096 - RNA, 3384 nt, synthetic construct; identical to SEQ ID NO: 11046
  misc_feature 1..3384: note = Cas13b variant__Prevotella buccae__EFU31981.1__Cas13b
  source 1..3384: mol_type = other RNA

SEQ ID NO: 11097 - RNA, 3384 nt, synthetic construct
  misc_feature 1..3384: note = Cas13b variant__Prevotella buccae__WP_004343581.1__Cas13b
  source 1..3384: mol_type = other RNA
atgcaaaaacaagataaattatttgtagatagaaagaaaaatgctatatttgcctttcctaaatatataacaataatggaaaaccaagagaaacctgaaccaatttattatgaattgacagataagcatttctgggctgcctttcttaacttggcgcgccacaatgtctataccaccattaatcacatcaacagacgtttggaaatagcagagctaaaagacgatggatatatgatggacattaaaggcagttggaacgaacaagcgaaaaaactcgacaaaaaagttcggctgagagacttgatcatgaaacactttccttttctggaagctgcagcttatgaaataacaaactctaaaagtcccaacaataaggagcaacgggaaaaggaacaatccgaagccctatcacttaacaacttgaagaatgttctattcattttcttggaaaaacttcaggttctcaggaactactactcccattacaagtattctgaagaatccccaaaaccgatatttgaaacaagccttttgaaaaacatgtataaggttttcgatgccaatgtgcggttagtaaagagagactatatgcatcatgagaatatagacatgcaaagagattttacacatctcaacaggaaaaaacaagtgggacgaacaaaaaacatcatagacagtcctaactttcattaccattttgcagataaagaaggcaatatgaccatagcaggcttactgttcttcgtctctttatttcttgataaaaaagacgctatttggatgcagaaaaagctaaagggatttaaagatggcagaaacttgcgtgagcaaatgacaaacgaagtattttgcagaagccgtatatctttgcctaagctaaaattggagaatgtacagacaaaagactggatgcaacttgatatgcttaacgaattggttcgctgtcccaaatcgctgtatgaacggttacgagaaaaagatagggaaagttttaaagtacctttcgatattttctctgacgactatgatgctgaagaagaaccatttaagaacacgcttgtaaggcatcaagaccgctttccatattttgtcttgagatatttcgatttaaatgagatattcgaacaactccgcttccaaatagatttaggtacctatcatttctctatctataacaaacgaatcggtgatgaggatgaagttcgccatctcacccatcatctgtatggttttgcgcgcatacaagactttgcacagcaaaaccaacccgaagtgtggaggaaattagtaaaagacttagattatttcgaggcatcgcaagagccttacatacctaagactgctccacattaccatttagagaatgaaaagataggcattaagttttgcagtacccacaacaacctctttccatctctcaaaacagaaaagacatgcaatggaagaagtaaatttaatctcggaacacaatttacggcagaagcatttttaagtgtccacgaattgttgccgatgatgttttattatctgttattgaccaaggattactccagaaaagaaagcgcagacaaagtagagggaattataagaaaagaaataagcaacatatacgctatctacgatgcttttgccaatggtgagataaatagcattgcagacctaacctgccgacttcaaaaaacaaatatactacaaggccatttgccaaagcaaatgatttccatattggaaggcagacaaaaagatatggaaaaagaggctgagcgcaagattggggaaatgatagacgacacccaaagaagacttgacttgctctgcaagcagacaaatcagaagataaggattggcaaaaggaatgccggtctgctaaaatcgggaaaaattgcagattggttggtaaatgacatgatgcgcttccaacctgttcaaaaagaccaaaataacattccaataaacaatagcaaggctaacagcaccgaatatcgaatgcttcagcgtgcgcttgcccttttcggcagtgagaacttccgccttaaggcatattttaatcaaatgaatcttgtggggaatgacaatccgcatcctttccttgcagaaacacaatgggaacatcaaactaacattctgtctttctaccgaaactatttggaagcgaggaaaaagtatcttaagggcttaaaaccacaaaactggaaacaatatcagcattttctcatacttaaagtacagaagaccaaccgcaacacattagttacaggatggaaaaacagtttcaatctcccccgtggaatatttacccaaccaataagggaatggtttgagaaacataataattcaaaaagaatatacgaccaaatactatcttttgaccgagtaggatttgttgcaaaagctattcccttatactttgcagaagaatataaagacaatgtacagcctttctacgattatccgttcaatatcggcaacaaacttaaaccccaaaaagggcaattcttagataaaaaagagcgtgtcgaattgtggcaaaagaataaagagctattcaaaaattatccgtctgaaaagaaaaagacagacttagcttatcttgatttcctatcatggaaaaagtttgaacgcgaactgcgacttatcaagaatcaggatatcgtcacatggttgatgttcaaagaactattcaatatggctactgtggaaggattgaagattggagaaatacatctgagggacattgatacaaacacggcaaatgaggaaagcaacaatattctaaatagaatcatgcccatgaagttgcctgttaaaacatacgaaacagacaataaaggaaatatattaaaggaaagacctttagcaaccttttatatcgaagaaacggaaaccaaagtcctgaaacagggcaatttcaaagtattggcaaaagaccgcaggctcaacggactactttcttttgcagaaactacagacattgatttagaaaaaaatcctatcaccaaattgagtgtagaccatgagcttataaaatatcagactacaaggattagtatctttgagatgacattaggactggaaaagaaactcataaacaaatatcccacactacctacagatagcttcagaaatatgcttgaaaggtggttgcagtgcaaagctaatagaccggaattaaagaattacgttaatagtttgattgcagtgagaaatgctttttcccacaaccagtatcccatgtatgatgccacactctttgctgaagttaaaaaatttacccttttcccttctgtcgatacaaaaaagattgagctaaatatagcgccacagttactggaaatagtaggaaaagccataaaagaaattgaaaaatcagaaaataaaaactaa

SEQ ID NO: 11098 - RNA, 3402 nt, synthetic construct
  misc_feature 1..3402: note = Cas13b variant__Prevotella falsenii__WP_036884929.1__Cas13b
  source 1..3402: mol_type = other RNA
atgaaaaacgataataactctacaaaatcaactgactatacgttaggtgataagcatttttgggcggcattccttaatttggcacgccacaatgtctatattacagtgaaccatattaacaaggtgctggagctaaaaaacaagaaagaccaagaaataattattgataatgaccaagacatattagccattaaaactctttggggaaaagttgatacagatattaataagaaagaccgattaagagaactgataatgaaacatttccctttcttggaagctgcgacatatcaacagagttctaccaataatacaaaacaaaaagaagaagaacaagccaaagcccaatcgtttgaaagtctgaaggattgtttatttctctttttagagaaacttcgggaagcaagaaactattattctcattacaagcattctaaatctttagaagaaccaaagttggaggaaaaattactggaaaatatgtataatatctttgataccaatgttcaattagtgataaaagattacgaacataacaaagatataaaccctgaagaagactttaagcatcttggcagagcagaaggagaattcaattattattttacaagaaataaaaaaggaaacataaccgaaagcggtttgctcttctttgtatccttattccttgaaaagaaagatgcaatatgggcacagacaaagattaaaggctttaaagacaatagggaaaacaaacagaaaatgacccatgaggtattttgcaggagccgaatgctcttgccaaaactgcgattggaaagcacgcaaacacaagactggatattgctcgatatgctcaacgagctgatacgttgccccaaatcgttgtacaaacgcctgcaaggagagaagagagaaaagttcagagtccccttcgatcctgcagacgaggactacgatgccgaacaagagcctttcaaaaacacattggtaaggcaccaagaccgtttcccttactttgcattgcgctatttcgactataacgagatattcacaaatcttcgtttccaaatagacttgggcacctatcacttctccatttataagaaacaaatcggtgataagaaggaagaccgccatcttacacataagctatatggttttgaacgcatacaagaatttgccaaagagaatcgacccgatgagtggaaagcacttgtaaaggatttagatacctttgaagaatcaaacgaaccgtatatctcggaaaccacaccgcattatcatttggagaaccaaaagataggcattagaaataagaataagaaaaagaaaaaaactatttggccatcacttgaaacaaaaacaacggtcaatgaaagaagtaagtacaatcttggtaaatcattcaaggcagaggcattcctaagcgtacacgagctattgccaatgatgttctattatctgttgttaaataaagaagaacctaacaatggaaagataaatgcaagtaaagtggaaggtatcattgagaaaaaaataagagatatatataaactctatggtgcttttgccaatgaagagataaacaacgaagaagaattaaaagaatactgtgagggcaaagatattgcaatacgacatctgcccaaacaaatgattgccatattgaaaaacgagtataaagatatggcaaaaaaggcagaagacaagcaaaagaaaatgataaaggacaccaagaagcgtcttgcagctcttgataaacaagtaaagggagaggtagaagatggtggacgaaatatcaaaccgttgaaatcaggtaggattgccagttggttggtaaatgatatgatgcgtttccaacctgtacaaagagatagagacggttatccactgaacaacagtaaagccaacagcacagaatatcagctgttgcagcgcacgcttgcactcttcggcagcgaacgtgaacgccttgctccttacttcagacaaatgaatctcataggaaaagacaacccacacccattcttgaaagataccaagtggaaggaacataacaatatcttgtctttctatcgcagctatttggaagcaaagaaaaactttctcggaagtctaaagcccgaagattggaagaagaaccaatatttccttaagcttaaagagccaaagaccaatcgcgaaacattggtgcaagggtggaaaaacggctttaatctgccacgtggaatctttacagagcctatcagagaatggtttataaggcatcagaatgaatcagaggaatacaagaaagttaaagacttcgatagaattggcttggttgcaaaagtaattcccttgttcttcaaagaagattaccaaaaagaaatagaagactatgtacagccattttatggctatcctttcaacgtgggcaatatacacaactcccaagaaggtacattcttgaataaaaaggaacgtgaagaactgtggaaaggaaataaaaccaagttcaaagattataaaaccaaagagaaaaacaaggaaaagacgaataaggataagttcaagaagaagacagatgaggaaaaggaagagttccgttcttatcttgattttcaatcttggaaaaagtttgagcgggaactacgacttgtacgaaaccaagacatcgtaacgtggctgttgtgtatggaactgattgataagctgaaaatagacgaactcaatatcgaagaactgcaaaagttgcgcttaaaggatattgatacagatacagcaaaaaaagaaaagaataatattctgaacagaataatgccgatggaactgcctgttacggtgtacgaaactgacgattccaacaatataataaaggataaacctttgcataccatttatataaaagaggctgaaaccaagcttttaaaacaaggaaactttaaggcattggtaaaagaccgcaggctcaatgggctgttctcgttcgttgaaacttcttctgaagcagaattgaagagtaaacctatcagcaaatcgcttgtagaatatgaactcggagagtatcaaagggcaagagtcgaaattatcaaagatatgttgagattagaagaaacgctgataggcaacgatgagaagttaccaaccaacaagttcagacaaatgcttgataagtggttggagcacaagaaagaaacggacgatacagatttgaagaatgacgtaaaactccttactgaggtgcggaatgccttttcgcacaatcaatacccaatgcgcgatagaatagcattcgcaaatattaaaccattcagcctttcttctgctaatacttccaacgaggagggacttggtattgccaagaaactgaaggataaaaccaaagaaacaatagacagaataatagaaatagaagaacaaacagcaactaaaagataa

SEQ ID NO: 11099 - RNA, 3402 nt, synthetic construct
  misc_feature 1..3402: note = Cas13b variant__Prevotella intermedia__BAU18623.1__Cas13b
  source 1..3402: mol_type = other RNA
atggaagacgacaagaaaaccacagattcaattagctacgagttaaaagataagcatttttgggcggcgttccttaatttggcacgccacaatgtctatattacagtgaaccacattaacaaggtactggagctaaaaaacaagaaagaccaagacataattattgataatgaccaagacatattggccattaaaactcattgggaaaaagttaatggagaccttaataagacagagcgactaagagaactgatgacaaaacacttcccattcttggaaactgcaatatacagcaaaaacaaagaagataaggaagaagtaaaacaagaaaaacaagccaaagcccaatcgtttgacagtctgaagcattgcttatttctctttttagagaagcttcaagaaacaagaaactattattctcattacaagtattctgaatctacaaaagagccaatgttagagaaagaattactgaaaaagatgtataatatctttgacgacaatatccagttagtgataaaagattaccaacataacaaagatataaatcccgacgaagacttcaagcatcttgacagaacagaagaagatttcaattattattttacaagaaataaaaaaggaaacataactgaaagcggcttgctcttcttcgtttccttattccttgaaaagaaagatgcaatatggatgcagcaaaagcttagaggctttaaagacaatagggaaagcaaaaagaaaatgacccacgaggttttttgcaggagccgaatgctcttgccaaaactacgattggaaagcacgcaaacacaagactggatattgctcgatatgctcaacgagctgatacgttgccccaaatcgctgtacgaacgcctacaaggagaggacagagaaaagttcaaagtccccttcgaccccgcagacgaagactacgatgcagagcaagagcctttcaaaaacaccttggtaaggcaccaagaccgtttcccttactttgcattgcgctatttcgactataacgagatattcacaaatcttcgtttccaaatagacttgggcacctttcacttctctatttataagaaactaatcggtggtcaaaaggaagaccgccaccttacgcataagctatacggttttgaacgcatacaagagtttgccaaacagaatcgccccgatgagtggaaagcaatcgtaaaggacttagatacttacgaaacttcaaacgaacgatatatctcggaaaccacaccgcattatcatttggaaaaccaaaagataggcattaggtttaggaatgataacgatgaaatttggccatcgctcaaaacaaatggcgaaaataatgaaaaaagcaagtataaacttgataaacaataccaagcagaagctttcttgagcgtacacgagctattgccaatgatgttctactatctgttgttaaagaaggaagaacctaataatgacaagaaaaacgcaagtatagtagaaggctttatcaaaagagaaatcagagacatgtataaactctacgatgcttttgccaatggtgagataaacaacatagacgatttagaaaaatactgtgaggacaaaggaatccccaaaagacatctgcccaaacagatggttgccattttgtacgacgagcataaagatatggtaaaagaggcgaaacgcaagcaaaggaaaatggtaaaggatacagagaaactgcttgctgctcttgaaaaacaaacacaagaaaaaacagaagatggtggaagaaatatcagactgctgaagtctggcgagattgccagatggctggtaaacgatatgatgcgtttccaacctgttcaaaaagacaatgagggcaatccactgaacaacagtaaagccaacagcacagaatatcagatgctgcaacgctcgcttgcgctttacaacaaggaagaaaaacctactcgttacttcagacaagtaaacctcataaatagcagcaatccccacccattcctaaaatggacgaagtgggaagaatgcaacaacatcttgtctttctatcgcagttacctaacgaaaaagatagaatttctgaataaactaaagcctgaagattgggagaagaaccaatacttccttaagcttaaagagccaaagaccaaccgcgaaacattggtgcaagggtggaagaacggctttaatctgccacgtggtatctttacagaacctatcagagaatggtttaaaaggcatcagaacgattctaaggaatacgagaaagttgaagccctcgacagagttggcttggttacaaaggtaatacccttgttcttcaaaaaagaagattctaaagacaaagaagaagatttaaaaaaagatgcccaaaaagaaattaacaactgcgtgcagccattctacagcttcccttacaacgtgggcaatatacacaaacccgacgaaaaggatttcttacatcgtgaggaacgtatagaactgtgggataaaaagaaagacaagttcaagggttataaagccaaagtaaagtccaagaagttgacggacaaggaaaaagaagaatatcgttcttatctcgaatttcaatcttggaacaagtttgagcgggaactacgacttgtacgaaaccaagacatcgtaacgtggctgttgtgtacggaactgattgataagctgaaagtggagggactgaacgtcgaagaactgaaaaagctacgcttaaaggatattgacacagacacagcaaaacaagaaaagaacaatattctgaacagagtaatgccgatgcagctacctgttacggtgtacgaaattgacgattcccacaatatagtaaaggacagacctttgcatactgtttacatcgaagaaactaaaaccaagcttttaaaacaaggaaacttcaaggctttggtaaaagaccgcaggctcaatggtctgttctcgttcgttgatacttcttctgaagcagagttgaagagtaaccctatcagcaaatcgcttgtagaatacgaactcggagagtatcaaaacgcaagaatagaaactattaaagatatgttgttgttagaagaaacactgattgaaaaatataaaaacttgccaaccgacaacttcagtgatatgctaaatggttggttggagggcaaagacgaggcagacaaagcaaggtttcagaacgatgtaaaactccttgttgccgtacggaatgccttttcgcacaaccaatacccaatgcgcaatagaatagcattcgcaaacattaatccattcagcctttcttctgctgatacttctgaagaaaagaaacttgatattgccaatcagctgaaggataaaacccacaaaataataaaaagaattatagaaatagaaaagccaatagaaactaaagaataa

SEQ ID NO: 11100 - RNA, 3405 nt, synthetic construct
  misc_feature 1..3405: note = Cas13b variant__Prevotella intermedia__AFJ07523.1__Cas13b
  source 1..3405: mol_type = other RNA
atgaaaatggaagacgacaagaaaaccaaagaatcaactaacatgttagacaacaagcatttttgggcggcgttccttaatttggcacgccacaatgtctatattacagtgaaccacattaacaaggtactggagctaaaaaacaagaaagaccaagacataattattgataatgaccaagacatattggccattaaaactcattgggaaaaagttaatggggaccttaataagacagagcgattaagagaactgatgacaaaacacttcccattcttggaaactgcaatatacaccaaaaacaaagaagataaggaagaagtaaaacaagaaaaacaagccaaagcccaatcgtttgacagtctgaagcattgtttatttctctttttagagaagcttcaagaagcaagaaactattattctcattacaagtattctgaatctacaaaagagccaatgttagagaaagaattactgaaaaagatgtataatatctttgacgacaatatccagttagtgataaaagattaccaacataacaaagatataaatcccgacgaagacttcaagcatcttgacagaacagaagaagaattcaattattattttacaacaaataaaaaaggaaacataaccgcaagcggtttgctcttcttcgtttccttattccttgaaaagaaagatgcaatatggatgcagcaaaagcttagaggctttaaggacaatagggaaagcaaaaagaagatgacccacgaggtattttgcaggagccgaatgctcttgccaaaactacgattggaaagcacgcaaacacaagactggatattgctcgatatgctcaacgagctgatacgttgccccaaatcgctgtacgaacgcctgcaaggagaatacagaaaaaagttcaatgtccccttcgactctgcagacgaagactacgatgcagagcaagagcctttcaaaaacacattggtaaggcaccaagaccgtttcccttactttgcattgcgctatttcgactataacgagatattcacaaatcttcgtttccaaatagacttgggcacctatcacttctccatttataagaaactaatcggtggtcaaaaggaagaccgccaccttacacataagctgtatggttttgaacgcatacaagagtttgccaaacaaaatcgcaccgatgagtggaaagctatcgtaaaggattttgacacttacgaaacttcagaagaaccatatatctcggaaaccgcaccgcattatcatttggagaaccaaaagattggtattaggtttaggaatgataacgatgaaatttggccatcgctcaaaacaaatggcgaaaataatgaaaaacgcaagtataaacttgataagcaataccaagcagaggctttcctaagcgtacacgagctactgccaatgatgttctactatctgttgttaaagaaggaagaacctaataatgacaagaaaaacgcaagtatagtagaaggctttattaaaagagaaatcagagatatatataaactctatgatgcttttgccaatggtgagataaacaacatagacgatttagaaaaatactgtgaggacaaaggaatccccaaaagacatctgcccaaacagatggttgccattttgtacgacgagcataaagatatggcagaagaggcgaaacgcaagcaaaaggaaatggtaaaggataccaagaaactgcttgctactcttgaaaaacaaacacaaggagaaatagaagatggtggaagaaatatcagactgctgaagtctggcgagattgccagatggctggtaaacgatatgatgcgtttccaacctgttcaaaaagacaatgagggcaatccactgaacaacagtaaagccaacagcacagaatatcagatgctgcaacgctcgcttgcgctttacaacaaggaagaaaaacctactcgttacttcagacaagtaaaccttataaatagcagcaatccccaccctttcctaaaatggacgaagtgggaagaatgcaacaacatcttgtctttctatcgcagttacctaacgaaaaagatagaatttctgaataaactaaagcctgaagattgggagaagaaccaatacttccttaagcttaaagagccaaagaccaaccgcgaaacattagtgcaagggtggaagaacggctttaatctgccacgtggtatctttacagaacctatcagagaatggtttaaaagacatcagaacgattctgaggaatacgagaaagttgaaaccctcgacagagttggcttggttacaaaggtaatacccttgttcttcaaaaaagaagattctaaagacaaagaagaatatttaaaaaaagatgcccaaaaagaaattaacaactgcgtacagccattctacggcttcccttacaacgtgggcaatatacacaaacccgacgaaaaggatttcttaccttctgaggaacgcaaaaaactatggggtgataagaaatacaagttcaagggttataaagccaaagtaaagtccaagaagttgacggacaaggaaaaagaagaatatcgttcttatctcgaatttcaatcttggaacaagtttgagcgggagctacgacttgtgcgaaaccaagacatcgtaacgtggctgttgtgtacggaactgattgataagctgaaagtggagggactgaacgtcgaagaactgaaaaagctacgcttaaaggatattgacacagacacagcaaaacaagaaaagaacaatattctgaacagagtaatgccgatgcagctacctgttacggtgtacgaaattgacgattcccacaatatagtaaaggatagacctttgcatactgtttacatcgaagaaactaaaaccaagcttttaaaacaaggaaacttcaaggctttggtaaaagaccgcaggctcaatggtctgttctcgttcgttgatacttcttctgaaacagagttgaagagtaaccctatcagcaaatcgcttgtagaatacgaactcggagagtatcaaaacgcaagaatagaaactattaaagatatgttgttgttagaagaaacactgattgaaaaatataaaaccttgccaaccgacaacttcagtgatatgcttaatggttggttggagggtaaagacgaggcagacaaagcaaggtttcagaacgatgtaaaactccttgttgccgtacggaatgccttttcgcacaaccaatacccaatgcgcaatagaatagcattcgcaaacattaatccattcagcctttcttctgctgatacttctgaagaaaagaaacttgatattgccaatcagctgaaggataaaacccacaaaataataaaaagaattatagaaatagaaaagccaatagaaactaaagaataa

SEQ ID NO: 11101 - RNA, 3399 nt, synthetic construct
  misc_feature 1..3399: note = Cas13b variant__Prevotella intermedia__WP_014708441.1__Cas13b
  source 1..3399: mol_type = other RNA
atggaagacgacaagaaaaccaaagaatcaactaacatgttagacaacaagcatttttgggcggcgttccttaatttggcacgccacaatgtctatattacagtgaaccacattaacaaggtactggagctaaaaaacaagaaagaccaagacataattattgataatgaccaagacatattggccattaaaactcattgggaaaaagttaatggggaccttaataagacagagcgattaagagaactgatgacaaaacacttcccattcttggaaactgcaatatacaccaaaaacaaagaagataaggaagaagtaaaacaagaaaaacaagccaaagcccaatcgtttgacagtctgaagcattgtttatttctctttttagagaagcttcaagaagcaagaaactattattctcattacaagtattctgaatctacaaaagagccaatgttagagaaagaattactgaaaaagatgtataatatctttgacgacaatatccagttagtgataaaagattaccaacataacaaagatataaatcccgacgaagacttcaagcatcttgacagaacagaagaagaattcaattattattttacaacaaataaaaaaggaaacataaccgcaagcggtttgctcttcttcgtttccttattccttgaaaagaaagatgcaatatggatgcagcaaaagcttagaggctttaaggacaatagggaaagcaaaaagaagatgacccacgaggtattttgcaggagccgaatgctcttgccaaaactacgattggaaagcacgcaaacacaagactggatattgctcgatatgctcaacgagctgatacgttgccccaaatcgctgtacgaacgcctgcaaggagaatacagaaaaaagttcaatgtccccttcgactctgcagacgaagactacgatgcagagcaagagcctttcaaaaacacattggtaaggcaccaagaccgtttcccttactttgcattgcgctatttcgactataacgagatattcacaaatcttcgtttccaaatagacttgggcacctatcacttctccatttataagaaactaatcggtggtcaaaaggaagaccgccaccttacacataagctgtatggttttgaacgcatacaagagtttgccaaacaaaatcgcaccgatgagtggaaagctatcgtaaaggattttgacacttacgaaacttcagaagaaccatatatctcggaaaccgcaccgcattatcatttggagaaccaaaagattggtattaggtttaggaatgataacgatgaaatttggccatcgctcaaaacaaatggcgaaaataatgaaaaacgcaagtataaacttgataagcaataccaagcagaggctttcctaagcgtacacgagctactgccaatgatgttctactatctgttgttaaagaaggaagaacctaataatgacaagaaaaacgcaagtatagtagaaggctttattaaaagagaaatcagagatatatataaactctatgatgcttttgccaatggtgagataaacaacatagacgatttagaaaaatactgtgaggacaaaggaatccccaaaagacatctgcccaaacagatggttgccattttgtacgacgagcataaagatatggcagaagaggcgaaacgcaagcaaaaggaaatggtaaaggataccaagaaactgcttgctactcttgaaaaacaaacacaaggagaaatagaagatggtggaagaaatatcagactgctgaagtctggcgagattgccagatggctggtaaacgatatgatgcgtttccaacctgttcaaaaagacaatgagggcaatccactgaacaacagtaaagccaacagcacagaatatcagatgctgcaacgctcgcttgcgctttacaacaaggaagaaaaacctactcgttacttcagacaagtaaaccttataaatagcagcaatccccaccctttcctaaaatggacgaagtgggaagaatgcaacaacatcttgtctttctatcgcagttacctaacgaaaaagatagaatttctgaataaactaaagcctgaagattgggagaagaaccaatacttccttaagcttaaagagccaaagaccaaccgcgaaacattagtgcaagggtggaagaacggctttaatctgccacgtggtatctttacagaacctatcagagaatggtttaaaagacatcagaacgattctgaggaatacgagaaagttgaaaccctcgacagagttggcttggttacaaaggtaatacccttgttcttcaaaaaagaagattctaaagacaaagaagaatatttaaaaaaagatgcccaaaaagaaattaacaactgcgtacagccattctacggcttcccttacaacgtgggcaatatacacaaacccgacgaaaaggatttcttaccttctgaggaacgcaaaaaactatggggtgataagaaatacaagttcaagggttataaagccaaagtaaagtccaagaagttgacggacaaggaaaaagaagaatatcgttcttatctcgaatttcaatcttggaacaagtttgagcgggagctacgacttgtgcgaaaccaagacatcgtaacgtggctgttgtgtacggaactgattgataagctgaaagtggagggactgaacgtcgaagaactgaaaaagctacgcttaaaggatattgacacagacacagcaaaacaagaaaagaacaatattctgaacagagtaatgccgatgcagctacctgttacggtgtacgaaattgacgattcccacaatatagtaaaggatagacctttgcatactgtttacatcgaagaaactaaaaccaagcttttaaaacaaggaaacttcaaggctttggtaaaagaccgcaggctcaatggtctgttctcgttcgttgatacttcttctgaaacagagttgaagagtaaccctatcagcaaatcgcttgtagaatacgaactcggagagtatcaaaacgcaagaatagaaactattaaagatatgttgttgttagaagaaacactgattgaaaaatataaaaccttgccaaccgacaacttcagtgatatgcttaatggttggttggagggtaaagacgaggcagacaaagcaaggtttcagaacgatgtaaaactccttgttgccgtacggaatgccttttcgcacaaccaatacccaatgcgcaatagaatagcattcgcaaacattaatccattcagcctttcttctgctgatacttctgaagaaaagaaacttgatattgccaatcagctgaaggataaaacccacaaaataataaaaagaattatagaaatagaaaagccaatagaaactaaagaataa

SEQ ID NO: 11102 - RNA, 3381 nt, synthetic construct
  misc_feature 1..3381: note = Cas13b variant__Prevotella intermedia__WP_036860899.1__Cas13b
  source 1..3381: mol_type = other RNA
atggaagacgacaagaaaaccacagactcaattcgctacgagttaaaagataagcatttttgggcggcgttccttaatttggcacgccacaatgtctatattacagtgaaccacattaacaagatactggaagaaggcgaaatcaaccgtgacggatacgaaactacccttaagaatacttggaacgaaattaaagatattaataagaaagaccgactaagcaaactgataataaaacacttcccattcttggaagctgcgacatatcgactgaatcctaccgataccacaaaacaaaaagaagagaaacaagccgaagcccaatctcttgaaagtctgagaaagtctttttttgtttttatatataaacttcgagacctaagaaatcattattcccactacaagcattctaaatctttagaaagaccaaagtttgaggaaggattattggaaaagatgtataatatctttaacgcaagtatccgcttagtaaaagaagattaccaatataacaaagatataaaccctgacgaagacttcaagcatcttgacagaacagaagaagaattcaattattattttacaaaagataacgaaggaaacataactgaaagtggtttgctcttctttgtatccttattccttgaaaagaaagatgcaatatggatgcagcaaaagcttagaggctttaaagacaatagggaaaacaaaaagaaaatgaccaatgaagtgttttgcaggagccgaatgctcttgccaaaactacgattgcaaagcacacaaacacaagactggatattgctcgatatgctcaacgagctgatacgttgccccaaatcgctgtacgaacgcctgcgagaagaggacagagaaaagttcagagttcccatcgaaatcgcagacgaagactacgacgcagagcaagagcctttcaaaaacacattggtaagacaccaagaccgtttcccttactttgcattgcgctatttcgactataacgagatattcacaaatcttcgtttccaaatagacttgggcacctatcacttctccatttataagaaacaaatcggtgattataaagaaagccatcatcttacgcataagctgtatggttttgaacgcatacaagaatttaccaagcagaatcgccccgatgaatggagaaaatttgtaaagactttcaactctttcgaaacttcaaaagagccgtatatcccagaaaccacaccgcattatcatttggagaaccaaaagataggcattagatttaggaatgataacgataaaatttggccatcgctcaaaacaaatagcgaaaagaatgaaaaaagtaagtataaacttgataaatcattccaagcagaggctttcctaagtgtacacgaactattgccaatgatgttctactatctgttgttaaagacggaaaacactgataatgacaatgaaatagaaacaaagaagaaagaaaataaaaacgataaacaggaaaaacataagatagaagaaatcattgagaataaaataacagaaatatatgctctttacgatacttttgccaatggtgagataaaaagcatagacgagttagaagaatactgtaaaggcaaagatattgaaataggacatctgcccaaacaaatgattgccatattgaaagatgagcataaagttatggcaacagaggcggaacgcaaacaagaagaaatgttagttgatgtccaaaagagccttgaatctcttgataatcaaataaatgaagagatagaaaacgttgaaagaaagaacagctcattgaaatctggcaagattgccagctggttggtaaacgatatgatgcgttttcagcctgttcaaaaagacaatgagggcaaaccactgaacaacagtaaagccaacagcacagaatatcagctgttgcaacgtacgcttgcattcttcggcagcgaacacgaacgccttgccccttacttcaaacaaacgaagctcatagagagtagcaaccctcacccattcttgaaggataccgagtgggaaaagtgcaacaatatcttgtctttctatcgcagctatttggaagcaaagaaaaactttcttgaaagtctaaagccagaagattgggagaagaaccaatacttccttaagcttaaagagccaaagaccaagcccaaaacattggtgcaagggtggaagaacggctttaatctaccacgtggaatctttacggaacccataaggaaatggtttatgaagcatcgggaaaacataacagtagccgagttaaaaagagttggcttggttgcaaaagtaattcctttgttcttcagtgaagaatataaggacagcgtacagccattttacaactatcattttaacgttggtaacataaacaaacccgatgaaaagaatttcttaaattgtgaggaacgtagagaactattgcgtaagaagaaagacgagttcaagaagatgacggacaaggaaaaagaagaaaacccttcttatctcgaatttaaatcttggaataagtttgaacgggagctacgacttgtgcgaaaccaagacatcgtaacgtggttgttgtgtatggagctgtttaataaaaagaagataaaggaactaaacgtcgaaaaaatatatttaaagaatattaatacaaatacaacaaaaaaagaaaaaaatacagaagaaaagaacggagaagaaaagaatataaaggaaaagaacaatattctgaataggataatgccaatgcgattacctattaaagtatatgggagagaaaacttctctaagaacaaaaagaagaagataagaaggaatactttttttaccgtttacattgaagaaaaaggaactaaactcttaaaacaaggcaacttcaaagctttggaaagagaccgcagattgggtggtctattctcgttcgttaaaactccttctaaagcagaatcgaagagtaatactatcagtaaattgcgtgtagaatatgaactcggagagtatcaaaaagcaagaatagaaattatcaaagatatgttggcgttagaaaaaacgctgatagacaaatacaatagcttggacaccgacaacttcaacaaaatgcttactgattggctggaactcaaaggcgagccagacaaagcaagtttccagaacgacgtagacctccttattgccgtacggaatgccttttcgcacaaccaatacccaatgcgcaatagaatagcattcgcaaacattaatccattcagcctttcttctgctaatacttctgaagaaaagggacttggtattgccaatcagctgaaggataaaacccacaaaacgatagaaaaaataatagaaatagaaaagccaatagaaactaaagaataa

SEQ ID NO: 11103 - RNA, 3363 nt, synthetic construct
  misc_feature 1..3363: note = Cas13b variant__Prevotella intermedia__WP_061868553.1__Cas13b
  source 1..3363: mol_type = other RNA
atggaagacgacaagaaaaccacagactcaattcgctacgagttaaaagataagcatttttgggcggcgttccttaatttggcacgccacaatgtctatattacagtgaaccatattaacaagatactggaagaagatgaaatcaaccgtgacggatacgaaaatacccttgagaatagttggaacgaaattaaagatattaacaagaaagaccgactaagcaaactgataataaaacacttcccattcttggaagctacgacatatcgacagaacccgaccgatacgacaaaacaaaaagaagagaaacaagccgaagcccaatctcttgaaagtctgaaaaagtctttttttgtttttatatataaacttcgagacctaagaaatcattattcccactacaagcattctaaatctttagaaaggccaaagtttgaggaagatttacaaaataagatgtataatatctttgatgtcagtatccagtttgtaaaagaagattataaacataatacagatataaaccctaaaaaagacttcaaacatcttgatagaaaaagaaaaggaaagttccattactcttttgcagataacgaaggaaacataactgaaagcggtttgctcttctttgtatccttattccttgaaaagaaagatgcaatatgggtacagaaaaaacttgaaggctttaaatgcagtaacaagtcatatcagaaaatgaccaatgaagtattttgcaggagccgaatgctcttgccaaaactacgattggaaagcacgcaaacacaagactggatattgctcgatatgctcaacgagctgatacgttgccccaaatcgctgtacgaacgcctgcaaggagtaaacagaaaaaagttctatgtctccttcgaccctgcagacgaggactacgatgcagagcaagagcctttcaaaaacacattggtaaggcaccaagaccgtttcccatactttgcattgcgctatttcgactataacgaggtattcgcaaatcttcgtttccaaatagacttgggcacctatcacttctccatttataagaaactaatcggtggtcaaaaggaagaccgccaccttacacataagctgtatggttttgaacgcatacaagagtttgacaagcagaatcgccccgatgagtggaaagcaatcgtaaaagactcagatactttcaagaaaaaagaagaaaaagaagaagaaaaaccgtatatctcggaaactacaccgcattatcatttggagaacaagaagattggcattgcatttaagaatcataatatttggccgtcaacccaaacagaactaacaaacaataaaagaaagaagtacaatcttgggacatcaatcaaagcagaggccttcctaagtgtacacgagttattgccaatgatgttctactatctgttgttaaagacggaaaatactaaaaatgacaataaagttggaggaaagaaagaaacaaagaagcaaggaaaacataagatagaagccattattgagagtaaaataaaagacatatatgccctttacgatgcttttgccaatggcgagataaacagcgaagacgaattaaaagaataccttaagggcaaagatattaaaatagtacatctgcccaaacaaatgattgccatattgaaaaacgagcataaagatatggcagaaaaggctgaagccaaacaagagaagatgaaacttgccacagaaaatcgtctaaaaactcttgataaacagctaaaaggaaagatacaaaacggtaaaagatacaacagcgcaccaaaatctggcgagattgccagctggttggtaaacgatatgatgcgtttccagcctgttcaaaaagacgaaaatggagaatcgctgaacaacagtaaagccaacagcacagaatatcagctgttgcaacgtacgcttgcattcttcggcagcgaacacgaacgccttgccccttacttcaaacaaacgaagctcatagagagtagcaaccctcacccattcttaaacgataccgagtgggaaaagtgcagcaatatcttgtctttctatcgcagctatttgaaagcaaggaaaaactttcttgaaagtctaaagccagaagattgggagaagaaccaatacttccttatgcttaaagagccaaagaccaaccgcgaaacattggtgcaagggtggaagaacggctttaatctgccacgtggattctttacggaacccataaggaaatggtttatggagcattggaaaagcataaaagtagacgacttaaaaagggttggcttggttgcaaaagtaactcctttgttcttcagtgaaaaatataaagacagcgtacagcctttttacaactatccttttaacgttggcgatgtaaacaaacccaaagaagaggatttcttacatcgtgaggagcgtatagaactgtgggataaaaagaaagacaagttcaagggttataaagccaaaaagaagttcaaggagatgacggacaaggaaaaagaagagcaccgttcttatcttgaatttcaatcttggaataagtttgagcgggaactacgacttgtgcgaaaccaagacatcgtaacgtggctgttgtgtacggaactgattgataagctgaaaatagacgaactcaatataaaagaactgaaaaagctacgcttaaaggatattaatacagacacagcaaaaaaagaaaagaacaatattctgaacagagtaatgccgatggaactgcctgttacggtgtacaaagtaaacaaaggaggctatataataaagaataaacctttgcataccatttatataaaagaggctgaaaccaagcttttaaaacaaggaaacttcaaggctttggtaaaagaccgcaggctcaatggtctgttctcgttcgttaaaactccttctgaagcagaatcggagagcaaccctatcagcaaattgcgtgtagaatatgaacttggaaagtatcaaaatgcaagactcgatattatcgaggatatgttggcgttagaaaaaaagctgatagacaaatacaatagcttggacaccgacaacttccacaatatgcttacaggttggttggaactcaaaggcgaggcaaagaaagcaaggtttcagaacgacgtaaaactccttactgccgtacggaatgccttttcgcacaaccaatatccaatgtacgatgaaaatctcttcggaaatattgagcggttcagcctttcttcttctaatattatagaaagtaaggggctcgatattgctgcaaaactgaaagaggaagttagtaaggcagcaaaaaaaatacagaacgaggaagataacaaaaaagaaaaagaaacttaa

SEQ ID NO: 11104 - RNA, 3378 nt, synthetic construct
  misc_feature 1..3378: note = Cas13b variant__Prevotella intermedia__KJJ86756.1__Cas13b
  source 1..3378: mol_type = other RNA
atgaaaatggaagacgacaagaaaaccacagaatcaactaacatgttagacaacaagcatttttgggcggcgttccttaatttggcacgccacaatgtctatattacagtgaaccacattaacaaggtactggagctaaaaaacaagaaagaccaagatataattattgataatgaccaagacatattggccattaaaactcattgggaaaaagttaatggagaccttaacaagacagagcgactaagagaactgatgacaaaacacttcccattcttggaaactgcaatatacaccaaaaacaaagaagataaggaagaagtaaaacaagaaaaacaagccgaagcacaatcacttgaaagcctaaaggattgtttatttctctttttagagaagcttcaagaagcaaggaactattattctcactacaagtattctgaatctacaaaagagccaatgttagaggaaggattattggaaaagatgtataatatctttgacgacaatatccagttagtgataaaagattaccaacataacaaagatattaaccctgacgaagacttcaagcatcttgacagaaaaggacaattcaaatactcttttgcagataacgaaggaaacataactgaaagcggtttgctcttcttcgtttccttattccttgaaaagaaagatgcaatatggatgcagcaaaagcttacaggctttaaagacaatagggaaagcaaaaagaaaatgacccacgaggtattttgcagaagacgaatgctcttgccaaaactacgattggaaagcacgcaaacacaagactggatattgctcgatatgctcaacgagctgatacgttgccccaaatcgctgtacgaacgcctgcaaggagaatacagaaaaaagttcaatgtccccttcgactctgcagacgaagactacgatgccgagcaagagcctttcaaaaatacattggtaagacaccaagaccgtttcccatactttgcattgcgctatttcgactataacgagatattcacaaatcttcgtttccaaatagacttgggcacctatcacttctccatttataagaaactaatcggtggtcaaaaggaagaccgccaccttacacataagctgtatggttttgaacgcatacaagagtttgccaaacagaatcgccccgatgagtggaaagcactcgtaaaggacttagatacttacgaaacttcaaacgaacgatatatctcagaaaccacaccgcattatcatttggagaaccaaaagataggcattaggtttaggaatggtaacaaggaaatttggccatcgctcaaaacaaatggcgaaaataatgaaaaaagcaagtataaacttgataaaccatatcaagcagaggctttcttgagcgtacacgagctactgccaatgatgttctactatctgttgttaaagaaggaagaacctaataatgacaagaaaaacgcaagtatagtagaaggctttattaaaagagaaatcagagacatgtataaactctatgatgcttttgccaatggtgagataaacaacataggcgatttagaaaaatactgtgaggacaaaggaatccccaaaagacatctgcccaaacagatggttgccattttgtacgacgagcctaaagatatggtaaaagaggcgaaacgcaagcaaaaggaaatggtaaaggataccaagaaactgcttgctactcttgaaaaacaaacacaagaagaaatagaagatggtggaagaaatatcagactgctgaagtctggcgagattgccagatggctggtaaacgatatgatgcgtttccaacctgttcaaaaagacaatgagggcaatccactgaacaacagtaaagccaacagcacagaatatcagatgctgcaacgctcgcttgcgctttacaacaaagaagaaaaacctactcgttacttcagacaagtaaatctcataaatagcagcaacccccacccttttctaaaatggacgaagtgggaagaatgcaacaacatcttgtctttctatcgcaattacctaacgaaaaagatagaatttctgaataaactaaagcctgaagattgggagaagaaccaatacttccttaagcttaaagagccaaagaccaaccgcgaaacattagtgcaagggtggaagaacggctttaatctgccacgtggtatctttacagaacctatcagagaatggtttaaaaggcatcagaacgattctaaggaatacgagaaagtcgaagccctcaaaagagttggcttggttacaaaggtaatacccttgttcttcaaagaagaatattttaaagaagatgcccaaaaagaaattaacaactgcgtgcagccattctacagcttcccttacaacgtgggcaatatacacaaacccgacgaaaaggatttcttaccttctgaggaacgcaaaaaactatggggtgataagaaagacaagttcaagggttataaagctaaagtaaagtccaagaagttgacggacaaggaaaaagaagaatatcgttcttatcttgaatttcaatcttggaataagtttgagcgggagctacgacttgtgcgaaaccaagacatcgtaacgtggctgttgtgtacggaactgattgataagatgaaagtggagggactgaacgtcgaagaactgcaaaagctacgcttaaaggatattgacacagacacagcaaaacaagaaaagaacaatattctgaacagaataatgccgatgcagctacctgttacggtgtacgaaattgacgattcccacaatatagtaaaggacagacctttgcatactgtttacatcgaagaaactaaaaccaagcttttaaaacaaggaaacttcaaggctttggtaaaagaccgcaggctcaatggtctgttctcgttcgttgatacttcttctaaagcagagttgaaagataaacctatcagcaaatcggttgtagaatacgaactcggagagtatcaaaacgcaagaatagaaactatcaaggatatgttgttgttagaaaaaacactgataaaaaaatatgaaaagttgccaaccgacaacttcagtgatatgctaaatggttggttagagggcaaagacgagtcagacaaagcaaggtttcagaacgacgtaaaactccttgttgccgtacggaatgccttttcgcacaaccaatacccaatgcgcaatagaatagcattcgcaaacattaacccattcagcctttcttctgctgacatttctgaagaaaagaaacttgatattgccaatcagctgaaggataaaacccacaaaataataaaaaaaataatagaaatagaaaagccaatagaaactaaagaataa

SEQ ID NO: 11105 - RNA, 3378 nt, synthetic construct
  misc_feature 1..3378: note = Cas13b variant__Prevotella pallens__EGQ18444.1__Cas13b
  source 1..3378: mol_type = other RNA
atgaaagaagaagaaaaaggaaaaacacccgtagtatcaacttataacaaggatgataagcatttttgggcggcgttccttaatttggcacgccacaatgtctatattacagtgaaccatattaacaagatactgggagaaggtgaaatcaaccgtgacggatacgaaaatacccttgagaagagttggaacgaaattaaagatattaacaagaaagaccgactaagcaaactgataataaaacatttcccattcttggaagttacaacatatcaacgaaactctgccgataccacaaaacaaaaagaagagaaacaagccgaagcccaatctcttgaaagtctgaaaaagtctttttttgtttttatatataaacttcgagacctaagaaatcattattcccactacaagcattctaaatctttagaaaggccaaagtttgaggaagatttacaagagaagatgtataatatctttgatgcaagtatccagttagtaaaagaagattataaacataatacagatataaaaactgaagaagacttcaagcatcttgacagaaaaggacaattcaaatactcttttgcagataacgaaggaaacataactgaaagcggtttgctcttcttcgtttccttattccttgaaaagaaagatgcaatatgggtacagaaaaaacttgaaggctttaaatgcagtaacgagtcatatcagaaaatgaccaatgaagtattttgcaggagccgaatgctcttgccaaaactacgattgcaaagcacacaaacacaagactggatattgctcgatatgctcaacgagctgatacgttgccccaaatcgctgtacgaacgcctgcgagaagaggacagaaaaaagttcagagtccccatcgaaatcgcagacgaagactacgatgcagagcaagagcctttcaaaaacgccttggtaaggcaccaagaccgtttcccttactttgcattgcgctatttcgactataacgagatattcacaaatcttcgtttccaaatagacttgggcacctatcacttctccatttataagaaacaaatcggtgattataaagaaagccatcatcttacgcataagctgtatggttttgaacgcatacaagaatttaccaagcagaatcgccccgatgaatggagaaaatttgtaaagactttcaactctttcgaaacttcaaaagagccgtatatcccagaaaccacaccgcattatcatttggagaaccaaaagataggcattagatttaggaatgataacgataaaatttggccatcgctcaaaacaaatagcgaaaagaatgaaaaaagtaagtataaacttgataaatcattccaagcagaggctttcctaagtgtacacgagctattgccaatgatgttctactatctgttgttaaagacggaaaacactgataatgacaatgaaatagaaacaaagaagaaagaaaataaaaacgataaacaggaaaaacataagatagaagaaatcattgagaataaaataacagaaatatatgccctttacgatgcttttgccaatggtaagataaacagcatagacaagttagaagaatactgtaaaggcaaagatattgaaataggacatctgcccaaacagatgattgccatattgaaaagcgagcataaagatatggcaacagaggcgaaacgcaagcaagaagaaatgttagctgatgtccaaaagagccttgaatctcttgataatcaaataaatgaagagatagaaaacgttgaaagaaagaatagctcattgaaatctggcgagattgccagctggttggtaaacgatatgatgcgtttccagcctgtacaaaaagacaatgagggcaatccactgaacaacagtaaagccaacagcacagaatatcagatgctgcaacgctcgcttgcgctttacaacaaggaagaaaaacctactcgttacttcagacaagtaaacctcatagagagtagcaaccctcacccattcttgaacaataccgagtgggaaaagtgcaacaatatcttgtctttctatcgcagctatttggaagcaaagaaaaactttcttgaaagtctaaagccagaagattgggagaagaaccaatacttccttatgcttaaagaaccaaagaccaactgcgaaacattggtgcaagggtggaagaacggctttaatctgccacgtggaatctttacagaacccataaggaaatggtttatggagcatcggaaaaacataacagtagccgagttaaaaagagttggcttggttgcaaaagtaattcctttgttcttcagtgaagaatataaggacagcgtacagcctttttacaactatctttttaacgttggtaacataaacaaacccgatgaaaagaatttcttaaattgtgaggaacgtagagaactattgcgtaaaaagaaagacgagttcaagaagatgacggacaaggaaaaagaagaaaacccttcttatcttgaatttcagtcttggaataagtttgaacgggagctacgacttgtgcgaaaccaagacatcgtaacgtggctgttgtgtatggagctgtttaataaaaagaagataaaggaactaaacgtcgaaaaaatatatttaaagaatattaatacaaatacaacaaaaaaagaaaaaaatacagaagaaaagaacggagaagaaaagattataaaggaaaagaataatattctgaataggataatgccaatgcgattacctattaaagtatatgggagagaaaacttctctaagaacaaaaagaagaagataagaaggaatactttttttaccgtttacattgaagaaaaaggaactaaactcttaaaacaaggcaacttcaaagctttggaaagagaccgcagattgggtggtctattctcgttcgttaaaactcattctaaagcagaatcgaagagtaatactatcagcaaatcacgtgtagaatatgaacttggagagtatcaaaaagcaagaatcgaaattatcaaagatatgttggcgttagaagaaacgctgatagacaaatacaatagcttggacaccgacaacttccacaatatgcttactggttggttgaaactcaaagacgagccagacaaagcaagtttccagaacgacgtagacctccttattgccgtacggaatgccttttcgcacaaccaatacccaatgcgcaatagaatagcattcgcaaatattaatccattcagcctttcttctgctaatacttctgaagaaaagggacttggtattgccaatcagctgaaggataaaacccacaaaacgatagaaaaaataatagaaatagaaaagccaatagaaactaaagaataa

SEQ ID NO: 11106 - RNA, 3453 nt, synthetic construct
  misc_feature 1..3453: note = Cas13b variant__Prevotella saccharolytica__EKY00089.1__Cas13b
  source 1..3453: mol_type = other RNA
atgatggaaaaagaaaatgtacaaggtagccatatctattatgaacctactgacaaatgcttctgggcggctttctataatctggctcgccacaacgcgtatcttaccatagcgcacatcaatagttttgtcaattctaaaaaaggaattaacaacgatgataaggttttagacatcattgatgattggagtaagtttgataacgacttgcttatgggtgcccgtttaaacaaacttattctcaaacattttccctttttaaaggcccctttataccagttggcaaagcggaaaacccgcaaacagcaaggaaaagagcagcaagattatgaaaaaaagggggatgaagacccggaagttattcaagaagcaatagcaaatgcctttaaaatggcgaatgttcgaaagactttacatgcttttttaaagcaacttgaagatttaagaaaccatttttcgcattataactataattctcctgccaaaaaaatggaggtaaaattcgatgatggcttttgtaacaagctttactacgtgtttgatgctgcgttgcaaatggtgaaggatgacaacagaatgaatccggaaattaatatgcaaacagattttgaacatcttgtgcgattaggtagaaaccgcaagattcctaatacgtttaaatacaactttacaaattctgacggaacgattaacaacaacggactgctcttttttgtatcgctttttctcgaaaagcgcgatgccatctggatgcaaaaaaagataaagggatttaaaggcggcaccgagaactatatgcggatgaccaatgaggtgttttgcagaaatagaatggtcattcctaaactgcgattagaaaccgattacgacaatcatcaactgatgttcgatatgctcaacgaactcgttcgatgccccctttcgttatacaaacgcttaaaacaggaagaccaagataaattccgggtacccatagagttccttgatgaggataatgaagctgacaatccatatcaagaaaacgccaacagtgatgaaaacccaactgaagaaaccgacccattaaagaatacactcgttcgtcatcagcaccgttttccctatttcgtgttgcgttatttcgatttaaacgaggtttttaaacagctccgctttcaaataaacttaggttgttatcatttttcgatatacgataaaaccattggcgaacgcactgaaaagcgccatcttacgcgcaccctctttgggtttgatcggttacagaacttctctgtcaagttgcaacctgagcattggaaaaatatggtgaaacatttggataccgaagagagttcagataagccttatctatctgatgcgatgcctcattatcagattgaaaatgaaaagataggcattcatttcttaaagaccgatacagagaaaaaagaaacggtatggccgtcgttagaggtcgaagaagtcagcagtaacagaaataaatacaagtctgagaagaacctcacggcagatgctttcctcagtacacacgagttattgcccatgatgttttattatcagctgttgagtagcgaagaaaaaactcgggctgcggcaggcgataaggtgcaaggtgtattgcaaagttaccgcaaaaagatttttgatatatacgatgattttgccaatggcaccatcaattctatgcaaaaacttgatgaacggttagcaaaagataacttgttaaggggaaatatgccccaacaaatgcttgcaatcttagaacatcaagagccggatatggagcagaaagcgaaagagaaactcgatcggctcataactgaaacgaaaaaaagaataggcaaattggaggatcaattcaaacaaaaagtaaggataggcaaacgccgcgcagacttaccgaaggtaggaagcattgccgattggctggttaacgacatgatgcgctttcaacctgcaaaacgtaatgccgataatacgggtgtgccggatagtaaagccaatagcaccgaatatcgtttgttgcaagaggcattggcattttatagcgcctataaagatcgtttggaaccttatttccgacaagtcaacctcataggtggcaccaatcctcatccgtttttacacagggttgattggaaaaaatgtaatcatctattatcattttatcacgattatctcgaagctaaagagcaatatctatcccatctatcgcctgctgattggcaaaagcatcaacatttcttgcttttaaaagtgagaaaagacatccagaatgaaaagaaagactggaaaaagagcttggttgcaggctggaaaaatggctttaatctaccacgcggactctttaccgagtctattaaaacatggttctcaacagatgcagataaggttcagattaccgacacaaagctttttgaaaaccgagtggggcttattgccaaacttatccctctatattacgataaggtgtacaatgacaagccccaacctttttatcaatacccctttaatatcaacgacagatataaacccgaagatacccgcaaacgatttacggcagcatcttctaagctgtggaacgaaaagaaaatgctttataaaaatgcacaaccggactcatctgacaaaatagagtatccgcaatatcttgatttcctgtcgtggaaaaagctcgaacgcgaactgcgtatgctgcgcaatcaagatatgatggtgtggttgatgtgcaaagatctctttgcacagtgtacggtagaaggggtagaatttgctgatttgaagttaagtcaattggaagtagatgttaatgtacaggacaatctaaatgttttgaacaatgtcagtagtatgatattgcccctgtcggtttatccttcggatgcgcaaggtaatgttctcagaaacagtaaacctctacacactgtttatgtacaagaaaataacactaaacttttaaagcagggcaactttaaatcgctattaaaagaccggcgtttaaatggcttattctctttcatcgcagctgaaggagaagacctgcaacagcatccgttgacaaaaaacaggctcgaatacgaattaagtatctatcaaacaatgcggatctctgtgtttgagcaaacgcttcaactcgaaaaagccatccttactcgaaacaaaacgctgtgtggtaacaactttaacaatttgctcaacagctggagcgaacaccgcacagataagaaaaccttacagcccgacatcgattttctgattgctgtgcgcaatgctttctcacacaaccaatatcccatgtctaccaatacggttatgcaaggtatcgaaaagtttaatatccaaacccccaaacttgaagaaaaagatggacttggaatagcttctcagctggcaaagaaaaccaaagatgctgccagccgtcttcaaaatatcataaatggaggaaccaactaa

SEQ ID NO: 11107 - RNA, 3969 nt, synthetic construct
  misc_feature 1..3969: note = Cas13b variant__Prevotella sp.__WP_036929175.1__Cas13b
  source 1..3969: mol_type = other RNA
atgagtaaagaatgcaaaaaacagcggcaggagaagaaacgtagactacagaaagccaacttcagtatcagtctaacgggcaagcatgtttttggcgcctattttaatatggcgcgtaccaattttgttaagaccatcaactatattttgccgattgcaggagtacgtggaaactattccgaaaaccaaataaacaaaatgcttcatgctctgtttttgatacaggcaggacgcaatgaagaattgactactgagcagaaacaatgggagaagaaactgcgtcttaatccagagcagcaaactaaattccaaaagctcctcttcaaacatttccctgtactcggcccaatgatggcagatgtggctgaccataaagcctatctcaataagaagaaatcaacggtgcagacagaggatgagacttttgccatgcttaaaggtgtgtcattggctgactgcttggatatcatctgtctcatggctgatactctcacagaatgccgcaatttctatacccacaaagacccttacaacaagccgtcgcaattagctgatcaatatctgcatcaggagatgattgccaaaaagttggataaggtagtggttgcaagccggcgtattttgaaagaccgcgaagggttgtctgttaatgaagtagaattcctaactggaatcgaccatttgcatcaagaggtgttaaaagatgaatttggtaatgcgaaggtaaaagatggcaaggtgatgaagacttttgttgaatacgatgatttctattttaagatctctggtaaacgtcttgtcaatggctataccgtcacaactaaggacgataagcctgttaatgtaaacactatgttgccagccctttccgactttggactactatatttctgcgtcctgttcctttcaaaaccatacgctaaattgtttattgacgaggttcgtctttttgaatacagcccgtttgatgacaaagaaaacatgattatgagcgagatgctcagtatctaccgtattcgtactccacgcctgcataagattgatagtcatgatagcaaggcaacactggctatggatatcttcggagaactgcgtcgttgccccatggaactctataacttgctcgacaagaatgctggacagccattcttccacgatgaagtgaaacatcccaatagtcatacacctgatgtttcaaaacgattgcgatatgacgaccgtttcccaacgttggcccttcgttatatcgacgaaactgagttattcaagcgcattcgctttcagctccagttaggttcttttcgttacaagttctacgataaggagaattgtatcgacggaagagtacgtgtgcgtcgtatccagaaagaaattaatggatatggacgaatgcaagaagtggctgacaagcgtatggataaatggggagacctgattcaaaaacgagaagaacgttcagtgaagctggaacacgaagaactatatattaacttggaccagtttcttgaggatacagccgattcaactccttacgttacagatcggcgacccgcctacaatattcatgctaatcgtattggattgtattgggaagatagccagaatcctaaacaatataaagtgtttgatgaaaacggaatgtatattccagaactagttgtgactgaagataaaaaggctcccattaagatgcctgcacctcgttgtgcacttagcgtctacgacctgcctgctatgcttttctatgaataccttcgcgaacaacaagataatgagttcccttctgccgagcaagttattattgaatatgaggacgactaccgcaagttcttcaaggctgtagcagaaggaaaactgaagccatttaagaggcccaaagagttccgtgattttttgaagaaagaatatccgaaactccggatggctgatatacccaagaaattgcaactttttttgtgtagtcatggtttatgttataacaataagcctgaaacggtgtatgaacgtttagatagacttactttgcagcatcttgaagaacgcgaacttcatattcagaatcgtttggagcactatcagaaagatcgtgatatgataggcaataaggataatcaatatggaaaaaagagcttttccgatgttcgccatggtgctcttgcacgttatctggctcaaagtatgatggagtggcaacctaccaaacttaaggataaagaaaagggtcatgataagttaacgggattaaactataatgttcttacagcctatcttgccacctatggccacccccaagttccagaagagggttttacacctcgcactttggagcaggttttaataaatgcacatctcataggaggcagtaatcctcatccttttataaataaggttttggctcttggcaacaggaatattgaggaactatatctgcactatttggaagaagaactcaaacatatccgctctcgtatacagtcattgtcgagtaatccttctgacaaggcattatctgcattaccttttattcatcacgaccgcatgagataccatgaacgtaccagcgaagagatgatggctttggcagcacgctataccactatacaactgccagatggtttgtttactccatatatcctggaaatactgcaaaagcattatactgagaactctgatctgcaaaatgctctcagccaagatgttccagtcaagcttaatccaacgtgcaatgctgcttatctcataacattattctatcagacagtattaaaggataatgcccagcctttctacttgtcagataagacctacactcggaataaagatggtgaaaaagcagagtcattctcgtttaaacgcgcctatgaattgttttccgtattaaataataacaagaaggatactttcccatttgaaatgattccgctgttcctaacaagcgatgagattcaggaacgcctgtctgcaaaactccttgacggcgatggaaatcctgtcccagaagtaggagaaaaaggtaaacctgcaacagatagtcagggtaatactatctggaagcgacgcatctattctgaagtggatgattacgctgaaaaattgactgacagggatatgaaaattagtttcaaaggcgaatgggaaaaactgccacgctggaaacaagataaaattattaagcgaagggatgaaactcgccggcagatgcgcgacgaactgttgcaacggatgccacgttatatacgtgatatcaaggacaacgaacgtacacttcgtcgctataagacgcaggatatggtattgtttctcctggctgagaagatgtttacaaatatcatcagcgaacagagcagtgaatttaattggaaacagatgcggctttccaaggtatgtaacgaggctttcctgcgtcagacgcttactttccgtgttccagtaacagttggtgaaacaaccatatatgtagaacaagagaatatgtcgctcaagaactatggtgagttctatcgtttccttacagatgatcgtctgatgagtctgttgaataacattgtggaaacgctaaaacctaatgagaatggcgaccttgttatccgtcataccgatttgatgagcgagctggctgcatacgatcagtatcgttctaccatcttcatgttgattcagagtatcgagaacttgattattacgaacaacgctgtacttgatgaccctgatgcagatggcttctgggttcgtgaagatcttcctaaacgcaataactttgcatcattattggaactgataaatcagttgaataatgtggagttgactgacgatgaacgtaagttactcgtcgccatccgtaatgccttcagtcataatagttataacattgacttctctctgattaaggatgttaagcatctgccagaagtcgccaaaggcattctgcaacatctgcaatcgatgcttggcgtagaaataacgaagtag

SEQ ID NO: 11108 - RNA, 3384 nt, synthetic construct
  misc_feature 1..3384: note = Cas13b variant__Prevotella sp.__WP_007412163.1__Cas13b
  source 1..3384: mol_type = other RNA
atgcaaaaacaagataaattatttgtagatagaaagaaaaatgctatatttgcctttcctaaatatataacaataatggaaaaccaagagaaacctgaaccaatttattatgaattgacagataagcatttctgggctgcctttcttaacttggcgcgccacaatgtctataccaccattaatcacatcaacagacgtttggaaatagcagagctaaaagacgatggatatatgatgggcattaaaggcagttggaacgaacaagcgaaaaaactcgacaaaaaagttcggctgagagacttgatcatgaaacactttccttttctggaagctgcagcttatgaaataacaaactctaaaagtcccaacaataaggagcaacgggaaaaggaacaatccgaagccctatcacttaacaacttgaagaatgttctattcattttcttggaaaaacttcaggttctcaggaactactactcccattacaagtattctgaagaatccccaaaaccaatatttgaaacaagccttttgaaaaacatgtataaggttttcgatgccaatgtgcggttagtaaagagagactatatgcatcatgagaatatagacatgcaaagagattttacacatctcaacaggaaaaaacaagtgggacgaacaaaaaacatcatagacagtcctaactttcattaccattttgcagataaagaaggcaatatgaccatagcaggcttactgttcttcgtctctttatttcttgataaaaaagacgctatttggatgcagaaaaagctaaagggatttaaagatggcagaaacttgcgtgagcaaatgacaaacgaagtattttgcagaagccgtatatctttgcctaagctaaaattagagaatgtacagacaaaagactggatgcaacttgatatgcttaacgaattggttcgctgtcccaaatcgctgtatgaacggttacgagaaaaagatagggaaagttttaaagtacctttcgatattttctctgacgactatgatgctgaagaagaaccatttaagaacacgcttgtaaggcatcaagaccgctttccatattttgtcttgagatatttcgatttaaatgagatattcgaacaactccgcttccaaatagatttaggtacctatcatttctctatctataacaaacgtattggtgacgaagatgaagttcgccatctcacacatcatctatatggctttgcgcgcattcaggactttgcaccacaaaaccaaccagaagaatggagaaaattagtgaaagacttagatcattttgagacatcgcaagagccttacatatctaagactgctccacattaccatttagagaatgaaaagataggcattaagttttgcagtacccacaacaacctctttccatctctcaaaagagaaaagacatgcaatggaagaagtaaatttaatctcggaacacaatttacggcagaagcatttttaagtgtccacgaattgttgccgatgatgttttattatctgttattgaccaaggattactccagaaaagaaagcgcagacaaagtagagggaattataagaaaagaaataagcaacatatacgctatctacgatgcttttgccaataatgagataaatagcattgcagacctaacctgccgacttcaaaaaacaaatatactacaaggccatttgccaaagcaaatgatttccatattggaaggcagacaaaaagatatggaaaaagaggctgagcgcaagattggggaaatgatagacgacacccaaagaagacttgacttgctctgcaagcagacaaatcagaagataaggattggcaaaaggaatgccggtctgctaaaatcgggaaaaattgcagattggttggtaagcgatatgatgcgtttccaacctgtccaaaaagacaccaataatgctcccataaacaacagcaaagccaatagcaccgaatatcggatgcttcagcatgcgcttgcgctttttggcagtgagagctcccgtcttaaagcttatttcaggcaaatgaaccttgtgggaaatgccaatccgcatcctttccttgcagaaacacaatgggaacatcaaactaacattctgtctttctaccgaaactatttggaagcgaggaaaaagtatcttaaaggcttaaaaccacaaaactggaaacaatatcagcattttctcatacttaaagtacagaagaccaaccgcaacacattagttacaggatggaaaaacagtttcaatctcccccgtggaatatttacccaaccaataagggaatggtttgagaaacataataattcaaaaagaatatacgaccaaatactatcttttgaccgagtaggatttgttgcaaaagctattcccttatactttgcagaagaatataaagacaatgtacagcctttctacgattatccgttcaatatcggcaacaaacttaaaccacaaaaagggcaattcttagataaaaaagagcgtgtcgaattgtggcaaaagaataaagagctattcaaaaattatccgtctgaaaagaataagacagacttagcttatcttgatttcctatcatggaaaaagtttgaacgcgaactgcgacttatcaagaatcaggatatcgtcacatggttgatgttcaaggaactattcaaaacgacaactgtggaaggattgaagattggggaaatacatctaagggacatcgatacaaacacggcaaatgaggaaagcaacaatattctaaatagaatcatgcccatgaagttgcctgttaaaacatacgaaacagacaataaaggaaatatattaaaggaaagacctttagcaaccttttatatcgaagaaacggaaaccaaagtcctgaaacagggcaatttcaaagtattggcaaaagaccgcaggctcaacggactactttcttttgcagaaactacagacattgatttagaaaaaaatcctatcaccaaattgagtgtagactatgagcttataaaatatcagactacaaggattagtatctttgagatgacattaggactggaaaagaaactcatagacaaatattccacactacctacagatagcttcagaaatatgcttgaaaggtggttgcagtgcaaagctaatagaccggaattaaagaattacgttaatagtttgattgcagtgagaaatgctttttcccacaaccagtatcccatgtatgatgccacactctttgctgaagttaaaaaatttacccttttcccttctgtcgatacaaaaaagattgagctaaatatagcgccacagttactggaaatagtaggaaaagccataaaagaaattgaaaaatcagaaaataaaaactaa

SEQ ID NO: 11109 - RNA, 3273 nt, synthetic construct
  misc_feature 1..3273: note = Cas13b variant__Prevotella sp.__WP_044072147.1__Cas13b
  source 1..3273: mol_type = other RNA
atgaatatacctgcattagtggaaaaccagaagaagtatttcggaacatactctgtcatggcaatgctgaacgcacagaccgtactcgaccacatacagaaagtggccgacatagagggggaacagaacgagaacaacgaaaatctatggttccaccccgtaatgagccatttatacaatgcgaagaatggatatgacaaacagccggaaaagactatgttcatcatcgaacgtctgcagtcatattttcctttcctcaagattatggctgaaaaccaaagagagtattcgaacggaaaatacaaacagaatagggttgaggtgaacagcaacgacatctttgaagttctgaaaagggctttcggtgtgctgaaaatgtatcgtgaccaggccagccattacaagacatacgatgagaagctgattgacggttgcgagtttctgacaagtactgagcagcctctttccggaatgataaacaactactacactgtagcactgcgaaacatgaatgagcgttatggatacaaaaccgaagacctcgcctttatacaggacaaaagattcaaattcgtcaaagacgcatacggaaaaaagaaatcacaagtaaataccggtttcttcctcagtttgcaagactacaacggcgacacacaaaagaaactccacttgtctggagtcggcatagccttgcttatctgtctgttcctcgacaagcagtatatcaacatcttcctgtcaaggcttcctatcttctcttcctataatgcacaatcggaagagcgacgcatcatcatccgttcttttggaataaacagcatcaagcagcccaaagaccgcatccactcggaaaagagcaacaagtcggtggccatggatatgctcaatgaaataaagcgttgtccaaacgaactgttcgaaacactctcggcagaaaagcagtctcgattcagaatcatttccaatgaccacaacgaagtgcttatgaagcgtagttccgacagattcgtgccattgctattgcaatatattgactacggcaagctgttcgaccacatccgttttcatgtgaatatggggaaactgcgctatctgctcaaagccgacaagacctgcatcgacggtcagacacgagtgagggtgatagaacagcctctcaacggtttcggaagattggaagaggttgaaacgatgagaaagcaagaaaacggaactttcggcaatagcggcattcgtattcgcgattttgagaacatgaaaagagacgatgccaatcctgcaaactatccatacatcgtggacacatacactcactatatactggagaacaacaaggtggaaatgttcataagcgatgaagaaacccctgccccattgttgcctgtaattgaggatgacagatatgtggtaaagaccattccatcctgccgtatgagcactcttgaaatacctgccatggcatttcatatgttcctgttcggtagcaaaaagaccgaaaagcttattgtcgatgttcacaacaggtataagagattgttcaaagcgatgcaaaaagaagaggtgacagctgaaaacatagcctctttcggcattgcagaaagtgatctgccccagaagattattgacctcatcagcgggaatgctcatggcaaggacgttgacgccttcatcaggcttaccgttgatgacatgcttgccgataccgaacggcgcatcaagagatttaaagacgaccgtaaatccatacgttctgccgacaacaagatgggcaagcgcggtttcaaacagatttctacaggtaagctggcggatttcctcgccaaagacattgtgttgttccaaccttctgtaaatgatggcgagaacaagattacgggattgaactaccgcatcatgcagtctgccatcgccgtttacaacagtggcgacgattatgaagccaagcaacagttcaagctgatgtttgagaaagcccggctcatcggcaaaggcacaacagagcctcatcctttcctatataaggtatttgtgcgctctatccctgccaatgccgtggatttctacgagaggtatctaatagagcgcaaattctatctcatcggactctccaacgagataaagaagggaaacagggtggatgtgcctttcatcagacgagaccagaacaaatggaaaacacctgctatgaagactctcggcagaatctatgatgaagacctgccggtggaattgcctcgacagatgttcgacaacgaaatcaagagccacctgaaatcgctgccgcagatggagggcattgatttcaataatgccaacgtcacgtatctcatcgcagaatatatgaaacgtgtattgaatgatgacttccagacattctatcagtggaagcgcaactatcgctatatggacatgctgaggggtgaatacgacagaaaaggctcgttgcagagctgtttcacatccgtagaagaaagagaaggtttatggaaagaacgtgcaagccggactgaacgctacagaaaactggcttcaaacaaaatcaggtctaacagacagatgcgtaatgcctcttctgaagaaattgaaacgatattagacaagcgtttgagtaacagccgcaacgaataccagaaaagtgagaaggtaatccgcagatacagagtacaggatgccctgctcttcttattggcaaagaagactctgacggaactggcggatttcgacggcgagagattcaaactgaaagagattatgcctgacgcagaaaagggaatcctgtctgagattatgcctatgtcattcacttttgaaaagggcggcaagaaatataccataacatcggaaggcatgaagctgaagaactatggtgatttcttcgtcttggcaagcgacaagagaatcggcaacctgttagaacttgttggctccgacactgtatccaaggaggacatcatggaagaattcaagaagtatgaccaatgccgaccggaaatatcgagcatcgttttcaacttggagaaatgggcattcgacacttatcctgagttgtcagcgagagttgacagagaagaaaaggttgatttcaagtccatcttaaagattctcctaaacaacaagaatatcaataaagaacaaagtgacatattgcgaaaaatcaggaatgctttcgaccacaacaactatcccgacaaaggtgttgttgagataagggctttgcctgaaattgccatgagcataaagaaagcatttggagaatatgccatcatgaaatag

SEQ ID NO: 11110 - RNA, 3273 nt, synthetic construct
  misc_feature 1..3273: note = Cas13b variant__Prevotella sp.__WP_042518169.1__Cas13b
  source 1..3273: mol_type = other RNA
atgaatatacctgcattagtggaaaaccagaagaagtatttcggaacatactctgtcatggcaatgctgaacgcacagaccgtactcgaccacatacagaaagtggccgacatagaaggtgaacagaacgagaacaacgaaaatctatggttccaccccgtaatgagccatttatacaatgcgaagaatggatatgacaaacagccggaaaagactatgttcatcatcgaacgcctgcagtcatattttcctttcctcaagattatggctgaaaaccaaagagagtattcgaacggaaaatacaaacagaatagggttgaggtgaacagcaacgacatctttgaagttctgaaaagggctttcggcgtgctgaaaatgtatcgcgacctaaccaaccattacaaaacctacgaagaaaagctgatcgacggctgcgagtttctgacaagtactgagcagcctctttccggaatgataagcaaatactacactgtagccctgcgaaacacaaaggagcgttatggatacaagaccgaagacctggcattcatacaggacaacataaaaaaaatcaccaaagacgcatacgggaaaaggaaatcacaagtaaatactggtttcttcctcagtctgcaagactacaacggcgacacacaaaagaaactccacttgtctggagtcggcatagccttgcttatctgtctgttcctcgacaagcagtatatcaacatcttcctgtcaaggcttcctatcttctcttcctataatgcacaatcggaagagcgacgcatcatcatccgttcttttggcataaacagcatcaaactgcccaaagaccgcatccactctgaaaagagcaacaagtcggtggctatggatatgctgaatgaggtgaagcgttgtccggacgaactgttcactacactctcggctgaaaagcagtctcgattcagaattatttccgacgaccacaacgaggtgcttatgaagcgtagcaccgacagattcgtgccattgctattgcaatatatcgactacggcaagttgttcgaccacatccgttttcatgtcaacatggggaaactgcgctatctgctcaaagccgacaagacctgcatcgacggtcagactcgagtgagggtgatagaacaacctctgaacggtttcggaagattggaagaggctgaaacgatgcgaaagcaagaaaacgggactttcggcaacagcggcatccgcattcgcgattttgagaatgtgaaaagagacgacgccaatccggcaaactatccatatatcgtggacacttacactcactatatactggaaaacaacaaggtggaaatgttcataagcgataaagggagctctgccccattgttgcctctgattgaggatgacagatatgtggtaaagaccattccatcctgccgtatgagcactcttgaaatacctgccatggcatttcatatgttcctgttcggtagcaaaaagaccgaaaagcttattgtcgatgttcacaacaggtataagagattgttccaagcgatgcaaaaagaagaggtaacagctgaaaacatagcctctttcggcattgctgaaagcgatctgccccagaagattcttgatctcatcagcggaaatgctcatggcaaggatgttgacgccttcatcaggcttaccgtcgacgacatgcttaccgataccgaacggcgcatcaagagatttaaagacgaccgcaaatccatacgttctgccgacaacaagatgggcaagcgcggtttcaaacagatttctacaggtaagctggcggatttcctcgccaaagacatcgttttgttccagccttctgtaaatgacggcgaaaacaagattacgggattgaactatcgcatcatgcagtctgccatcgccgtttacgacagtggcgacgattatgaagccaagcaacagttcaagctgatgtttgagaaagcccggctcatcggcaaaggcacaacagagcctcatcctttcttatataaggtctttgcgagatctatccctgccaacgccgtggatttctacgagaggtatctaatagagcgcaagttctatctcaccggactctgcaacgagataaagaggggaaacagggtggatgtgcctttcatcagacgtgaccagaacaaatggaaaacacctgctatgaagactctcggcagaatctactctgaagacctgccggtggagttgcctcgacagatgtttgacaacgaaatcaagagccacctgaaatcgctgccgcagatggagggcattgatttcaataatgccaacgtcacgtatctcatcgcagaatatatgaaacgtgtattgaatgatgacttccagacattctatcagtggaagcgcaactatcactatatggacatgctgaagggggaatacgacaggaaaggttcgctgcagcactgcttcacatccgtagaagaaagagaaggtttatggaaagaacgtgcaagccggactgaacgctacaggaaactggcttcaaacaaaatcaggtctaacagacagatgcgtaatgcctcttctgaagaaatcgaaacgatattagacaagcgtttgagtaactgccgcaacgaataccagaaaagtgagaaggtgatccgcagatacagagtacaggatgcgctgctcttcttattggcaaagaagactctgacggaactggcggatttcgacggcgagagattcaagctgaaagagattatgcctgatgcagaaaagggaatcctgtctgagattatgcctatgtcattcacttttgaaaagggcggcaagaaatataccataacatcggaaggcatgaagctgaagaactatggtgatttcttcgtcttggcaagcgacaagagaatcggcaacttgttagaacttgttggctccgacattgtatccaaggaggacatcatggaagaattcaataagtatgaccaatgccgacctgaaatatcgagcatcgtattcaacttagagaaatgggcattcgacacttatcctgagttgtcagcgagagttgacagagaagaaaaggttgatttcaagtccatcttaaagattctcctaaacaacaagaatatcaataaagaacaaagtgacatattgcgaaaaatcaggaatgctttcgaccacaacaactatcccgacaaaggtattgttgagataaaggctttgcctgaaattgctatgagcattaaaaaagcattcggagaatatgccatcatgaaatag

SEQ ID NO: 11111 - RNA, 3273 nt, synthetic construct
  misc_feature 1..3273: note = Cas13b variant__Prevotella sp.__WP_044074780.1__Cas13b
  source 1..3273: mol_type = other RNA
atgaatatacctgcattagtggaaaaccagaagaagtatttcggaacatactctgtcatggcaatgcttaacgcacagaccgtactcgaccacatacagaaagtggccgacatagaaggtgaacagaacgagaacaacgaaaatctatggttccaccccgtaatgagccatttatacaatgcgaagaatggatatgacaaacagccggaaaagactatgttcatcatcgaacgcctgcagtcatattttcctttcctcaagattatggctgaaaaccaaagagagtattcgaacggaaaatacaaacagaatagggttgaggtgaacagcaacgacatctttgaagttctgaaaagggctttcggcgtgctgaaaatgtatcgcgacctaaccaaccattacaaaacctacgaagaaaagctgatcgacggctgcgagtttctgacaagtactgagcagccgttttccggaatgataagcaaatactacactgtagccctgcgaaacacaaaggagcgttatggatacaaggccgaagacctggcattcatacaggacaacagatacaaattcacaaaagacgcatacgggaaaaggaaatcacaagtaaacactggttccttcctcagtctgcaagactacaacggcgatacgacaaagaagctccatctctcaggagtcggcatagccctgctcatttgcctgttcctcgacaagcagtatatcaacctcttcctgtcaaggcttcctatattctcttcatacaatgcacaatcagaagagcgacgcatcatcatccgttcttttggaataaacagcatcaagcagcccaaagaccgcatccactcggaaaagagcaacaagtcggtggctatggatatgctgaatgaggtgaagcgttgtccggacgaactgttcactaccctctcggctgaaaagcagtctcgattcagaattatttccgacgaccacaacgaggtgcttatgaagcgcagttccgacaggttcgtgccattgttgttgcaatatattgactacggcaagttgttcgaccacatccgttttcatgtgaatatggggaagctgcgctatcttctgaaagccgacaagacctgcatcgacggtcagacacgagtgagggtgatagaacagcctctcaacggtttcggaagattggaagaggttgaaacgatgagaaagcaagaaaacggaactttcggcaatagcggcattcgcattcgcgattttgagaacatgaaaagagacgatgccaatcctgcaaactatccatacatcgtggaaacatacactcactatatactggagaacaacaaggtggaaatgttcattagcgatgaagaaaaccctaccccattgttgcctgtaattgaggatgacaggtatgtggtaaagaccattccatcctgccgcatgagcactcttgaaataccagccatggcgtttcatatgttcctgttcgggagcgagaagaccgaaaagctgataatcgatgttcatgacaggtacaagagattgttccaagcgatgcaaaaagaagaggtgacagctgaaaacatagcctctttcggcattgctgaaagcgatctgccccagaagattatggatcttatcagcggaaatgctcatggcaaggacgttgacgcattcatcagacttaccgtcgacgacatgcttaccgataccgaacggcgcatcaagagatttaaagacgaccgtaaatccatacgttctgccgacaacaagatgggcaagcgcggtttcaaacagatttctacaggtaagctggcggatttcctcgccaaagacattgtgttgttccaaccttctgtaaatgatggcgagaacaagattacgggattgaactaccgcatcatgcagtctgccatcgccgtttacgacagtggcgacgattatgaagccaagcaacagttcaagctgatgtttgagaaagcccggctcatcggcaaaggcacaacagagcctcatcctttcctatataaggtatttgtgcgctctatccctgccaatgccgtggatttctacgagaggtatctaatagagcgcaaattctatctcatcggactctccaacgagataaagaagggaaacagggtggatgtgcctttcatcagacgagaccagaacaaatggaaaacaccagcgatgaagactctcggcagaatctactctgaagacctgccggtggaattgcctcgacagatgtttgacaacgaaatcaagagccacctgaaatcgctgccgcagatggagggcattgatttcaataatgccaacgtcacgtatctcatcgcagaatatatgaaacgtgtattgaatgatgacttccagacattctatcagtggaagcgcaactatcgctatatggacatgctgaggggtgaatacgacagaaaaggttcgctgcagcactgcttcacatccatagaagaaagagaaggtttatggaaagaacgtgcaagccggactgaacgctacaggaaactggcttcaaacaaaatcaggtctaacagacagatgcgtaatgcctcttctgaagagatcgaaacgatattagacaagcgtttgagcaactgccgcaacgaataccagaaaagcgagaagataattcgccgatacagggtacaggatgccctgctcttcttattggcaaagaagactctgacggaactggcggatttcgacggcgagagattcaagctgaaagagattatgcctgacgcagaaaagggaatcctgtctgagattatgcctatgtcattcacttttgaaaagggcggcaagatatataccataacatcgggaggtatgaagttgaaaaactatggtgatttcttcgtcttggcaagcgacaagagaatcggcaacttgttagaacttgttggctccaacactgtatccaaggaggacatcatggaagaattcaagaagtatgaccaatgccgacctgaaatatcgagcatcgtattcaacttagagaaatgggcattcgatacttatcctgagttgccggcgagagttgacagaaaagaaaaagttgatttctggagcatcttagatgttctctcaaacaacaaggatatcaataatgagcaaagttacatattgcgaaaaatcaggaatgctttcgatcacaacaactatccagacaaaggtattgttgagataaaggctttgcctgaaattgccatgagcataaagaaagcatttggagaatatgccatcatgaaatag

SEQ ID NO: 11112 - RNA, 3438 nt, synthetic construct
  misc_feature 1..3438: note = Cas13b variant__Psychroflexus torquis__WP_015024765.1__Cas13b
  source 1..3438: mol_type = other RNA
atggaaagtattataggtttagggttatcattcaatccgtacaaaacggctgacaaacactattttggaagttttttaaatttagttgagaacaatttgaacgctgtttttgcagaatttaaagaacgtatatcatataaagctaaagatgaaaatatttcaagtttaatagaaaagcattttattgataatatgtccattgttgattatgaaaagaaaatttcgattttaaatggatatctgcccattatagactttttagatgatgaattagaaaataacctaaacacaagagttaagaactttaaaaagaactttatcatcttggcagaagcaatagaaaagctaagagactactacactcatttttatcatgatcctataacatttgaagataacaaagaacctttattagaattactagacgaggttcttttaaaaacaattttggatgtcaagaaaaaatatttaaaaactgataaaacaaaagagattcttaaagattctttaagagaagaaatggacctcctagttatcagaaaaaccgatgaattaagagagaaaaagaaaaccaatcctaaaattcaacatacagattcttcacaaattaaaaattctatatttaatgatgctttccaaggcttattatatgaggataaaggaaataacaagaaaactcaagtcagtcatagagcaaaaacaagattaaacccaaaagacatacacaagcaagaggaaagggatttcgaaattcctctttctactagtggattagtttttctgatgtcacttttcttatccaaaaaagagatagaagattttaaatcaaatattaaagggtttaagggaaaagtagtcaaagacgagaatcacaatagtcttaaatacatggctacacatagagtgtattctattcttgcatttaaaggtttaaaataccgcataaaaacagacacttttagtaaagaaacattaatgatgcaaatgatagatgaacttagtaaagttccagattgtgtctatcaaaatttaagtgaaaccaaacaaaaagattttatagaagattggaatgaatattttaaagacaacgaagaaaatacagaaaatcttgaaaactcgcgtgtcgttcacccagtaatcagaaaacgctatgaggataaattcaattattttgcaatccgatttttagatgaatttgccaattttaaaacgctcaagtttcaagtttttatgggttactatatccacgaccaaagaacaaaaacaattggaaccacaaatatcacaactgaacgaacggtaaaagaaaaaatcaacgtttttggtaagttatcaaaaatggataaccttaaaaaacactttttttctcagctatcggatgatgaaaatacagattgggaattcttcccaaatcctagctataatttccttacccaagcagacaactcacctgcaaataatattccgatttatttggaactaaagaaccaacaaatcattaaagaaaaggatgccataaaagcagaagttaatcaaacacaaaacaggaatcctaataaaccttccaaaagagatttgctaaacaagattttaaaaacatacgaagattttcatcaaggagacccaactgctattctaagtttaaatgaaattcctgctttacttcatctatttttagtaaaacctaataataaaacaggtcagcaaattgagaacataattaggatcaagattgaaaaacaatttaaagctatcaaccatccatctaaaaacaataaagggattcctaaatctctatttgcagatacaaacgtaagagttaatgccattaagctgaaaaaagatttggaagcagagctagacatgttgaataaaaagcatattgctttcaaagaaaaccaaaaggcttcaagtaattatgataagttattaaaagagcatcaattcaccccaaaaaataaaagaccagagttaagaaagtatgttttttacaagtctgaaaaaggcgaagaagcaacttggcttgctaatgatatcaaaagatttatgccaaaagactttaaaacaaaatggaaaggatgccagcatagtgaactgcaaagaaagttagctttttacgataggcataccaaacaagacatcaaagagcttttatctggttgtgagtttgaccattctcttttagacataaatgcatattttcaaaaagataactttgaagatttcttctctaaatatctagaaaacagaatagaaacgttggagggtgttttaaaaaaactccatgactttaaaaatgagcctacacctctaaagggagtttttaaaaattgctttaaatttttaaaacgacaaaactatgtaactgaaagtccagaaatcattaaaaaaagaattttagccaaacccacctttttgcctagaggtgtttttgatgaaagacctacaatgaaaaaaggaaaaaatcctttaaaagataagaatgagtttgcggagtggtttgttgaatacctggagaataaggattatcaaaaattttataatgctgaggaataccgaatgagagatgctgattttaaaaaaaatgcagtcatcaaaaaacaaaaactgaaagacttttatacgctacaaatggtcaactatttgttgaaggaagtctttgggaaagatgagatgaacttgcagctttcagagctatttcaaactagacaagagcgtctgaaactgcaaggtattgctaaaaaacaaatgaataaagaaacgggggatagtagtgaaaacactaggaaccaaacttatatctggaataaagatgtacccgtttccttttttaacggcaaagtaactatagataaagtaaaactaaaaaatattggaaaatataaaagatacgaacgtgatgaaagggtaaaaacatttattggctacgaagtagatgaaaaatggatgatgtatctaccacacaattggaaagacagatacagtgtaaaacccatcaatgtaatagacttacaaatacaggaatatgaagaaataagaagtcatgaattattaaaagaaatacagaatcttgaacagtacatttatgatcatacaacagacaaaaatattttattacaagatggaaatcccaattttaaaatgtatgttctgaatgggcttttaataggcatcaaacaagtaaatatacccgattttatagtgttaaagcagaatactaactttgataaaattgattttacaggcatagcatcttgtagcgaacttgaaaaaaagactatcattttaatagccataagaaataagtttgctcacaaccaattgccaaacaaaatgatatacgatttagcaaatgaatttcttaaaatagaaaaaaatgaaacctatgctaactattatttaaaggttttaaagaaaatgatttcagatttagcatag

SEQ ID NO: 11113 - RNA, 2847 nt, synthetic construct
  misc_feature 1..2847: note = Cas13b variant__Riemerella anatipestifer__WP_049354263.1__Cas13b
  source 1..2847: mol_type = other RNA
atgtttttttcatttcataatgcacaacgggttatttttaaacatctttacaaagcctttgatgcttctttacgaatggtaaaagaggactacaaagcccactttaccgtcaacctcactcgggactttgcccatctaaacagaaaaggtaaaaacaagcaagacaaccctgacttcaaccgctaccgcttcgaaaaagacggcttttttacagaatcagggctattgtttttcactaatctatttttggataaacgcgatgcctactggatgctgaaaaaagtcagtggttttaaagccagtcataaacaaagagaaaaaatgaccaccgaagtgttttgcagaagccgcatactccttcctaaattaaggttagagagccgatacgaccataaccaaatgctcttggatatgctttctgaactgagccgttgccctaaactgctctatgaaaaactctccgaagagaataaaaaacattttcaggtagaagctgatggctttttggacgaaattgaggaagaacaaaacccttttaaagataccttgatcagacatcaagaccgtttcccttattttgctctacgctatttagacctcaatgagtcttttaagtccataaggtttcaagtggatttaggcacttaccattactgtatttacgacaagaaaataggcgatgaacaagagaaacgccacctgacccgaaccctattgagcttcggtaggctacaagatttcacagagataaatcgtcctcaagagtggaaggctctcaccaaagaccttgactataaagagacttccaatcagccatttattagtaaaaccactccgcactaccacattaccgataacaaaatcggcttccgcttaggaacttctaaagagttgtacccttcgttggagataaaagacggtgccaaccgcatagccaaatatccctataattccggttttgtagctcatgcttttatcagtgtccacgaattgttacctctgatgttctaccagcatttaactggtaaatcggaagacttgttgaaggaaaccgttagacatatccaaaggatttacaaagactttgaagaagaacgcatcaacacgattgaagatttagaaaaagccaaccaaggtcgccttcctttaggcgcctttccaaaacaaatgttgggcttactgcaaaataaacaacccgacctttcggaaaaagccaaaatcaaaatagaaaaactaatagccgaaaccaagctgctctcccaccgcctcaacaccaaactaaaaagctctccaaagctcggaaagagacgagaaaagctcatcaagacaggcgtattggctgattggctggtgaaagactttatgcgatttcagcctgtggcttacgatgctcaaaaccaacctataaagagcagtaaagccaacagcacggaattttggtttatccgaagagcattagccttgtacggaggcgaaaagaacagactagaaggctactttaagcaaaccaacctcatcggaaataccaacccgcacccgttcctaaataaattcaattggaaagcgtgtaggaatctggtggacttttaccaacagtatctggaacaaagagaaaaattcttagaagctatcaaaaaccaaccttgggagccgtaccagtactgcctacttcttaaaataccgaaagagaatagaaaaaatctggttaaaggttgggaacaagggggcattagtctgccaagagggctgtttaccgaagcgattagagagaccctttcggaagacctcatgctatccaaacctattagaaaggagattaaaaaacacggcagagtaggctttatctccagagccattacactgtactttaaggaaaagtaccaagacaagcaccagagtttttacaacctttcgtacaagttagaagccaaggcaccgctgctaaagagggaagaacactacgaatattggcaacagaacaaaccccaaagccctacggagtctcagaggctggagttgcatacttctgaccgatggaaagactacctcctctacaaacgctggcaacatttggagaagaaacttaggctctacagaaaccaagatgttatgctttggctgatgaccttagagctgacaaaaaatcactttaaagaactgaatctgaactaccaccagctcaaattagagaacttggcggtcaatgttcaggaagcagacgccaagctcaatccgctgaaccaaaccttgcctatggtgttgcctgtaaaagtctatcctgccactgcatttggggaagtacaataccataaaacaccgataagaaccgtctatatccgagaagagcataccaaagcccttaaaatggggaactttaaagccttggtaaaagaccgccgtcttaacggtttgtttagctttatcaaagaggagaacgatacccaaaagcacccgattagtcagctcagattaaggcgggagttggagatttaccaatcgctaagggtagatgcctttaaagaaaccctgagcttggaagagaaactactgaacaaacacaccagtctctccagtttagagaatgagtttcgtgcattattggaagaatggaagaaagagtatgctgcttcatccatggttacggacgagcatatcgcctttatcgcctcggtacgcaatgccttctgccataaccaataccctttttacaaggaagccctccacgctcctattccgctctttacggttgcccagccaaccaccgaagaaaaagacggcttaggcattgccgaagcattgctaaaagtcttgcgtgaatattgcgaaattgttaaatctcaaatttag

SEQ ID NO: 11114 - RNA, 3288 nt, synthetic construct
  misc_feature 1..3288: note = Cas13b variant__Riemerella anatipestifer__WP_004919755.1__Cas13b
  source 1..3288: mol_type = other RNA
atggaaaaacctttactaccgaatgtttacacactgaaacacaagttcttttggggagccttccttaacattgcaaggcataatgcttttatcaccatctgccatatcaacgaacagttggggcttaagaccccttcaaatgatgacaaaatcgtagatgttgtctgtgagacatggaataacatactcaacaacgaccacgatttactcaaaaagagccaactaacggaacttatcctaaaacacttcccgttcctgacggcaatgtgctaccaccctcctaaaaaagagggaaaaaagaaggggcaccaaaaagagcagcagaaagagaaagaaagcgaagcccaatctcaagccgaggctcttaatccaagcaaattgattgaggcgttggaaatccttgtaaatcaactccacagtcttaggaactactatagccactacaaacacaaaaaacccgatgcagaaaaagatatttttaaacatctttacaaagcctttgatgcttctttacgaatggtaaaagaggactacaaagcccactttaccgtcaacctcactcgggactttgcccatctaaacagaaaaggtaaaaacaagcaagacaaccctgacttcaaccgctaccgcttcgaaaaagacggcttttttacagaatcagggctattgtttttcactaatctatttttggataaacgcgatgcctactggatgctgaaaaaagtcagtggttttaaagccagtcataaacaaagagaaaaaatgaccaccgaagtgttttgcagaagccgcatactccttcctaaattaaggttagagagccgatacgaccataaccaaatgctcttggatatgctttctgaactgagccgttgccctaaactgctctatgaaaaactctccgaagagaataaaaaacattttcaggtagaagctgatggctttttggacgaaattgaggaagaacaaaacccttttaaagataccttgatcagacatcaagaccgtttcccttattttgctctacgctatttagacctcaatgagtcttttaagtccataaggtttcaagtggatttaggcacttaccattactgtatttacgacaagaaaataggcgatgaacaagagaaacgccacctgacccgaaccctattgagcttcggtaggctacaagatttcacagagataaatcgtcctcaagagtggaaggctctcaccaaagaccttgactataaagagacttccaatcagccatttattagtaaaaccactccgcactaccacattaccgataacaaaatcggcttccgcttaggaacttctaaagagttgtacccttcgttggagataaaagacggtgccaaccgcatagccaaatatccctataattccggttttgtagctcatgcttttatcagtgtccacgaattgttacctctgatgttctaccagcatttaactggtaaatcggaagacttgttgaaggaaaccgttagacatatccaaaggatttacaaagactttgaagaagaacgcatcaacacgattgaagatttagaaaaagccaaccaaggtcgccttcctttaggcgcctttccaaaacaaatgttgggcttactgcaaaataaacaacccgacctttcggaaaaagccaaaatcaaaatagaaaaactaatagccgaaaccaagctgctctcccaccgcctcaacaccaaactaaaaagctctccaaagctcggaaagagacgagaaaagctcatcaagacaggcgtattggctgattggctggtgaaagactttatgcgatttcagcctgtggcttacgatgctcaaaaccaacctataaagagcagtaaagccaacagcacggaattttggtttatccgaagagcattagccttgtacggaggcgaaaagaacagactagaaggctactttaagcaaaccaacctcatcggaaataccaacccgcacccgttcctaaataaattcaattggaaagcgtgtaggaatctggtggacttttaccaacagtatctggaacaaagagaaaaattcttagaagctatcaaaaaccaaccttgggagccgtaccagtactgcctacttcttaaaataccgaaagagaatagaaaaaatctggttaaaggttgggaacaagggggcattagtctgccaagagggctgtttaccgaagcgattagagagaccctttcggaagacctcatgctatccaaacctattagaaaggagattaaaaaacacggcagagtaggctttatctccagagccattacactgtactttaaggaaaagtaccaagacaagcaccagagtttttacaacctttcgtacaagttagaagccaaggcaccgctgctaaagagggaagaacactacgaatattggcaacagaacaaaccccaaagccctacggagtctcagaggctggagttgcatacttctgaccgatggaaagactacctcctctacaaacgctggcaacatttggagaagaaacttaggctctacagaaaccaagatgttatgctttggctgatgaccttagagctgacaaaaaatcactttaaagaactgaatctgaactaccaccagctcaaattagagaacttggcggtcaatgttcaggaagcagacgccaagctcaatccgctgaaccaaaccttgcctatggtgttgcctgtaaaagtctatcctgccactgcatttggggaagtacaataccataaaacaccgataagaaccgtctatatccgagaagagcataccaaagcccttaaaatggggaactttaaagccttggtaaaagaccgccgtcttaacggtttgtttagctttatcaaagaggagaacgatacccaaaagcacccgattagtcagctcagattaaggcgggagttggagatttaccaatcgctaagggtagatgcctttaaagaaaccctgagcttggaagagaaactactgaacaaacacaccagtctctccagtttagagaatgagtttcgtgcattattggaagaatggaagaaagagtatgctgcttcatccatggttacggacgagcatatcgcctttatcgcctcggtacgcaatgccttctgccataaccaataccctttttacaaggaagccctccacgctcctattccgctctttacggttgcccagccaaccaccgaagaaaaagacggcttaggcattgccgaagcattgctaaaagtcttgcgtgaatattgcgaaattgttaaatctcaaatttag

SEQ ID NO: 11115 - RNA, 3288 nt, synthetic construct
  misc_feature 1..3288: note = Cas13b variant__Riemerella anatipestifer__WP_064970887.1__Cas13b
  source 1..3288: mol_type = other RNA
atggaaaaacctttaccaccgaatgtttacacactgaaacacaagttcttttggggagccttccttaacattgcaaggcataatgcttttatcaccatttgccatatcaacgaacagttggggcttacgacccctccaaacgatgacaaaatcgcagatgttgtctgtgggacatggaataacatactcaacaacgaccacgatttactcaagaagagccaactaacggagcttatcctaaaacacttcccgttccttgcggcaatgtgctaccaccctcctaaaaaagagggaaaaaagaaaggtagccaaaaagagcagcagaaagagaaagaaaacgaagcccaatcgcaagccgaggctcttaatccaagtgaattgattaaggtattgaaaacccttgtaaagcaactccgcactcttagaaactactacagccaccacagccacaaaaaacccgatgcagaaaaagacatttttaagcatctttacaaagcctttgacgcttctttacgaatggtaaaagaggactacaaagcccactttaccgtcaacctcactcaggactttgcccatctaaacagaaaaggtaagaacaagcaagacaaccctgacttcgaccgctaccgctttgaaaaagacggcttttttacagaatcagggctattgtttttcactaatctgttcttggacaaacgcgatgcctactggatgctgaaaaaagtcagtggttttaaagccagtcataaacaaagcgaaaaaatgactaccgaagtgttttgcagaagccgtatactccttcctaaactaaggttagagagccgatacgaccataaccaaatgctcttggatatgctttctgaactgagccgttaccctaaactgctctatgaaaaactctccgaagaggataaaaaacgctttcaggtagaagctgatggctttttggacgaaattgaggaagaacaaaaccctttcaaagataccttaatcaggcatcaagaccgtttcccttattttgctctacgctatttagacctcaatgagtcttttaagtccataagatttcaagtggatttaggcacttaccattactgtatttacgacaagaaaataggcgatgaacaagagaaacgccacctgacccgaactctattgagcttcggtaggctacaagatttcacagagataaaccgtccccaagaatggaaagctctcaccaaagacctcgactataaagaaacttccaaacagccatttattagtaaaaccactccgcactaccacattaccgataacaaaatcggcttccgcttaggaacttctaaagagttgtacccttcgttggaggtaaaagacggtgccaaccgcatagcccagtacccttataattccgattttgtagctcatgcttttatcagtgtccacgaattgttacctctgatgttctaccagcatttaactggtaaatcggaagacttgttgaaggaaaccgttagacatatccaaaggatttacaaagactttgaagaagaacgcatcaacacgattgaagatttagaaaaagccaaccaaggtcgccttcctttaggagcctttccaaaacaaatgttgggcttactgcaaaataaacaacccgacctttcggaaaaagccaaaatcaaaatagaaaaactaatagccgaaaccaagctgctctcccatcgcctcaataccaaactaaaaagctctccaaagctcggaaagagacgagaaaagctcatcaagacaggcgtattggctgattggctggtgaaagactttatgcgatttcagcctgtggcttacgatgctcaaaatcaacctatagagagcagtaaagccaacagcacagaatttcagcttatccaaagagcattagccttgtacggaggcgaaaagaaccgattagaaggctactttaaacaaaccaacctcatcggaaataccaacccgcacccgttcctaaataaattcaattggaaagcgtgcagaaatttggtggacttttaccaacagtatctggaacaaagagaaaaattcttagaagctatcaaaaaccaaccttgggaaccataccagtactgcctacttcttaaaataccgaaagagaatagaaaaaatctggttaaaggttgggaacaagggggcattagcctgccaagaggactgtttaccgaagcaattagagagaccctttcaaaagacctcacgctgtccaaacctattagaaaggagattaaaaaacacggcagagtgggctttatctccagagccattacgctgtactttagggaaaagtaccaagacgaccaccagagtttttacgaccttccgtacaagttagaagccaaggcatcgccgctaccgaagaaagaacactacgaatattggcagcagaacaaaccccaaagccctacggaattgcagaggctggagttgcatacctctgaccgatggaaagactacctcctctacaaacgctggcaacatttggagaagaaacttaggctctacagaaaccaagatgttatgctttggctgatgaccttagagctgacaaaaaatcactttaaagaactgaatctgaactaccaccagctcaaattagagaacttggcggtcaatgttcaggaagcagacgccaaactcaatccgctgaaccaaaccttgcctatggtgttgcctgtaaaagtctatcctgccactgcatttggggaagtacaataccaagaaacaccgataagaaccgtctatatccgagaagagcagactaaagcccttaaaatggggaactttaaagccttggtaaaagaccgccgtcttaacggtttgtttagctttatcaaagaggagaacgacacccaaaagcacccgattagtcagctcagactaaggcgggagttggagatttaccagtcgctaagggtagatgcctttaaagaaaccttgaacttggaagagaaactactgaagaaacacaccagcctctccagcgtagagaataagttccgaatattgttggaagaatggaagaaagagtatgctgcttcctccatggttacggacgagcatatcgcctttatcgcctcggtacgcaatgccttctgccataaccaataccctttttatgaggaagccctccacgctcctattccgctctttacggttgcccagcaaaccaccgaagaaaaagacggcttaggcattgccgaagcattgctaagagtcttgcgtgaatattgcgaaattgttaaatctcaaatttag

SEQ ID NO: 11116 - RNA, 2853 nt, synthetic construct
  misc_feature 1..2853: note = Cas13b variant__Riemerella anatipestifer__WP_061710138.1__Cas13b
  source 1..2853: mol_type = other RNA
atgtttttttcatttcataatgcacaacgggttatttttaaacatctttacaaagcctttgatgcttctttacgaatggtaaaagaggactacaaagcccactttaccgtcaacctcactcgggactttgcccatctaaacagaaaaggtaaaaacaagcaagacaaccctgacttcaaccgctaccgcttcgaaaaagacggcttttttacagaatcagggctattgtttttcactaatctgttcttggataaacgcgatgcctactggatgctgaaaaaagtcagtggttttaaagccagtcataaacaaagcgaaaaaatgactaccgaagtgttttgcagaagccgtatactccttcctaaactaaggttagagagccgatacgaccataaccaaatgctcttggatatgctttctgaactgagccgttgccctaaactgctctatgaaaaactctccgaaaaggataaaaaatgttttcaggtagaagctgatggctttttggacgaaattgaggaagaacaaaacccttttaaagacaccttaatcaggcatcaagaccgtttcccttatttcgctctacgctatttagacctcaatgagtcttttaagtccataaggtttcaagtggatttaggcacttaccattactgtatttacgacaagaaaataggctatgaacaagagaaacgccacctgacccgaaccctattgaacttcggtaggctgcaagatttcacagagataaaccgtccccaagagtggaaggctctcaccaaagacctcgactataacgaaacttccaatcaaccatttattagtaaaaccactccgcactaccacattaccgataacaaaatcggcttccgcttaagaacttctaaagagttgtacccttcgttggaggtaaaagacggtgccaaccgcatagccaaatatccctataattccgattttgtggctcatgcttttatcagtatcagtgtccacgaattgttacctctgatgttctaccagcatttaactggtaaatcggaagacttgttgaaagaaaccgttaggcatatccaaaggatttacaaagactttgaagaagaacgcatcaacacgattgaggatttagaaaaagccaaccaaggtcgccttcctttaggagcctttccaaaacaaatgttgggcttactgcaaaacaaacaacccgacctttcggaaaaagccaaaatcaaaatagaaaaactaatagccgaaaccaaactcctttcccaccgcctcaataccaagctaaaaagctctccaaagctcggaaagagacgagaaaagctcatcaagacgggcgtattggctgattggctggtgaaagactttatgcgatttcagcctgtggtttacgatgctcaaaaccaacctataaagagcagtaaagccaacagcacggagtctcggcttatccgaagagcattagccttgtatggaggcgaaaagaaccgactggaaggctactttaaacaaaccaacctcatcggaaataccaacccgcaccctttcctaaataaattcaattggaaagcgtgcagaaatttggtggacttttaccaacagtatctggaacaaagagaaaaattcttagaagctatcaaacaccaaccttgggaaccgtaccagtactgcctacttcttaaagtaccgaaagagaatagaaaaaatctggttaaaggttgggaacaaggaggcattagcctgccaagagggctgtttaccgaagcgattagagagaccctttcaaaagacctcacgctatccaaacctattagaaaggagattaaaaaacacggcagagtgggctttatctccagagccattacactgtactttaaggaaaagtaccaagacaagcaccagagtttttacaacctttcgtacaagttagaagccaaggcaccgctgctaaagaaggaagaacactacgaatattggcaacagaacaaaccccaaagccctacggagtcgcagaggctggagttgcatacctctgaccgatggaaagactacctcctctacaaacgctggcaacatttggagaaaaaacttaggctctacagaaaccaagatattatgctttggctgatgaccttagagctgacaaaaaatcactttaaagaactgaatctgaactaccaccagctcaaattagagaacttggcggtcaatgttcaggaagcagacgccaaactcaatccgctgaaccaaaccttgcctatggtgttacctgtaaaagtctatcctaccactgcatttggggaagtacaataccatgaaacacctataagaaccgtctatatccgagaagagcagactaaagcccttaaaatggggaactttaaagccttggtaaaagaccgccatcttaacggtttgtttagttttatcaaagaggagaacgacacccaaaagcacccgattagtcagctcagattaaggcgggagttggagatttaccagtcgctaagggtagatgcctttaaagaaaccttgagcttggaagagaaactactgaataaacacgccagcctctccagtttagagaatgagtttcgtacattgttggaagaatggaaaaagaagtatgctgcttcctccatggttacggacaagcatatcgcctttatcgcctcggtacgcaatgccttctgccataaccaataccctttttacaaggaaaccctccacgctcctattctgctctttacggttgcccagccaaccaccgaagaaaaagacggcttaggtattgccgaagcgttgctaagagtcttgcgtgaatattgcgaaattgttaaatctcaaatttag

SEQ ID NO: 11117 - RNA, 2850 nt, synthetic construct
  misc_feature 1..2850: note = ARMAN Cas9 variant__Candidatus Micrarchaeum acidiphilum__OJI07263.1__Cas9
  source 1..2850: mol_type = other RNA
atgagagactctattactgcacctagatacagctccgctcttgccgccagaataaaggagtttaattctgctttcaagttaggaatcgacctaggaacaaaaaccggcggcgtagcactggtaaaagacaacaaagtgctgctcgctaagacattcctcgattaccataaacaaacactggaggaaaggaggatccatagaagaaacagaaggagcaggctagccaggcggaagaggattgctcggctgcgatcatggatactcagacagaagatttatggcaagcagcttcctgacccatacaaaatcaaaaaaatgcagttgcctaatggtgtacgaaaaggggaaaactggattgacctggtagtttctggacgggacctttcaccagaagccttcgtgcgtgcaataactctgatattccaaaagagagggcaaagatatgaagaagtggccaaagagatagaagaaatgagttacaaggaatttagtactcacataaaagccctgacatccgttactgaagaagaatttactgctctggcagcagagatagaacggaggcaggatgtggttgacacagacaaggaggccgaacgctatacccaattgtctgagttgctctccaaggtctcagaaagcaaatctgaatctaaagacagagcgcagcgtaaggaggatctcggaaaggtggtgaacgctttctgcagtgctcatcgtatcgaagacaaggataaatggtgtaaagaacttatgaaattactagacagaccagtcagacacgctaggttccttaacaaagtactgatacgttgcaatatctgcgatagggcaacccctaagaaatccagacctgacgtgagggaactgctatattttgacacagtaagaaacttcttgaaggctggaagagtggagcaaaacccagacgttattagttactataaaaaaatttatatggatgcagaagtaatcagggtcaaaattctgaataaggaaaagctgactgatgaggacaaaaagcaaaagaggaaattagcgagcgaacttaacaggtacaaaaacaaagaatacgtgactgatgcgcagaagaagatgcaagagcaacttaagacattgctgttcatgaagctgacaggcaggtctagatactgcatggctcatcttaaggaaagggcagcaggcaaagatgtagaagaaggacttcatggcgttgtgcagaaaagacacgacaggaacatagcacagcgcaatcacgacttacgtgtgattaatcttattgagagtctgcttttcgaccaaaacaaatcgctctccgatgcaataaggaagaacgggttaatgtatgttactattgaggctccagagccaaagactaagcacgcaaagaaaggcgcagctgtggtaagggatcccagaaagttgaaggagaagttgtttgatgatcaaaacggcgtttgcatatatacgggcttgcagttagacaaattagagataagtaaatacgagaaggaccatatctttccagattcaagggatggaccatctatcagggacaatcttgtactcactacaaaagagataaattcagacaaaggcgataggaccccatgggaatggatgcatgataacccagaaaaatggaaagcgttcgagagaagagtcgcagaattctataagaaaggcagaataaatgagaggaaaagagaactcctattaaacaaaggcactgaataccctggcgataacccgactgagctggcgcggggaggcgcccgtgttaacaactttattactgaatttaatgaccgcctcaaaacgcatggagtccaggaactgcagaccatctttgagcgtaacaaaccaatagtgcaggtagtcaggggtgaagaaacgcagcgtctgcgcagacaatggaatgcactaaaccagaatttcataccactaaaggacagggcaatgtcgttcaaccacgctgaagacgcagccatagcagcaagcatgccaccaaaattctggagggagcagatataccgtactgcgtggcactttggacctagtggaaatgagagaccggactttgctttggcagaattggcgccacaatggaatgacttctttatgactaagggcggtccaataatagcagtgctgggcaaaacgaagtatagttggaagcacagcataattgatgacactatatacaagccattcagcaaaagtgcttactatgttgggatatacaaaaagccgaacgccatcacgtccaatgctataaaagtcttaaggccaaaactcttaaatggcgaacatacaatgtctaagaatgcaaagtattatcatcagaagattggtaatgagcgcttcctcatgaaatctcagaaaggtggatcgataattacagtaaaaccacacgacggaccggaaaaagtgcttcaaatcagccctacatatgaatgcgcagtccttactaagcatgacggtaaaataatagtcaaatttaaaccaataaagccgctacgggacatgtatgcccgcggtgtgattaaagccatggacaaagagcttgaaacaagcctctctagcatgagtaaacacgctaagtacaaggagttacacactcatgatatcatatatctgcctgctacaaagaagcacgtagatggctacttcataataaccaaactaagtgcgaaacatggcataaaagcactccccgaaagcatggttaaagtcaagtatactcaaattgggagtgaaaacaatagtgaagtgaagcttaccaaaccaaaaccagagataactttggatagtgaagatattacaaacatatataatttcacccgctaa

SEQ ID NO: 11118 - RNA, 2904 nt, synthetic construct
  misc_feature 1..2904: note = ARMAN Cas9 variant__Candidatus Parvarchaeum acidiphilum__APG80630.1__Cas9
  source 1..2904: mol_type = other RNA
atgttaggctccagcaggtacctccgttataacctaacctcgtttgaaggcaaggagccatttttaataatgggatattacaaagagtataataaggaattaagttccaaagctcaaaaagaatttaatgatcaaatttctgaatttaattcgtattacaaactaggtatagatctcggagataaaacaggaattgcaatcgtaaagggcaacaaaataatcctagcaaaaacactaattgatttgcattcccaaaaattagataaaagaagggaagctagaagaaatagaagaactcggctttccagaaagaaaaggcttgcgagattaagatcgtgggtaatgcgtcagaaagttggcaatcaaagacttcccgatccatataaaataatgcatgacaataagtactggtctatatataataagagtaattctgcaaataaaaagaattggatagatctgttaatccacagtaactctttatcagcagacgattttgttagaggcttaactataattttcagaaaaagaggctatttagcatttaagtatctttcaaggttaagcgataaggaatttgaaaaatacatagataacttaaaaccacctataagcaaatacgagtatgatgaggatttagaagaattatcaagcagggttgaaaatggggaaatagaggaaaagaaattcgaaggcttaaagaataagctagataaaatagacaaagaatctaaagactttcaagtaaagcaaagagaagaagtaaaaaaggaactggaagacttagttgatttgtttgctaaatcagttgataataaaatagataaagctaggtggaaaagggagctaaataatttattggataagaaagtaaggaaaatacggtttgacaaccgctttattttgaagtgcaaaattaagggctgtaacaagaatactccaaagaaagagaaggtcagagattttgaattgaagatggttttaaataatgctagaagcgattatcagatttctgatgaggatttaaactcttttagaaatgaagtaataaatatatttcaaaagaaggaaaacttaaagaaaggagagctgaaaggagttactattgaagatttgagaaagcagcttaataaaacttttaataaagccaagattaaaaaagggataagggagcagataaggtctatcgtgtttgaaaaaattagtggaaggagtaaattctgcaaagaacatctaaaagaattttctgagaagccggctccttctgacaggattaattatggggttaattcagcaagagaacaacatgattttagagtcttaaatttcatagataaaaaaatattcaaagataagttgatagatccctcaaaattgaggtatataactattgaatctccagaaccagaaacagagaagttggaaaaaggtcaaatatcagagaagagcttcgaaacattgaaagaaaaattggctaaagaaacaggtggtattgatatatacactggtgaaaaattaaagaaagactttgaaatagagcacatattcccaagagcaaggatggggccttctataagggaaaacgaagtagcatcaaatctggaaacaaataaggaaaaggccgatagaactccttgggaatggtttgggcaagatgaaaaaagatggtcagagtttgagaaaagagttaattctctttatagtaaaaagaaaatatcagagagaaaaagagaaattttgttaaataagagtaatgaatatccgggattaaaccctacagaactaagtagaatacctagtacgctgagcgacttcgttgagagtataagaaaaatgtttgttaagtatggctatgaagagcctcaaactttggttcaaaaaggaaaaccgataatacaagttgttagaggcagagacacacaagctttgaggtggagatggcatgcattagatagtaatataataccagaaaaggacaggaaaagttcatttaatcacgctgaagatgcagttattgccgcctgtatgccaccttactatctcaggcaaaaaatatttagagaagaagcaaaaataaaaagaaaagtaagcaataaggaaaaggaagttacacggcctgacatgcctactaaaaagatagctccgaactggtcggaatttatgaaaactagaaatgagccggttattgaagtaataggaaaagttaagccaagctggaaaaacagcataatggatcaaacattttataaatatcttttgaagccatttaaagataacctgataaaaatacccaacgttaaaaatacatacaagtggataggagttaatggacaaactgattcattatccctcccgagtaaggtcttatctatctctaataaaaaggttgattcttctacagttcttcttgtgcatgataagaagggtggtaagcggaattgggtacctaaaagtatagggggtttgttggtatatataactcctaaagacgggccgaaaagaatagttcaagtaaagccagcaactcagggtttgttaatatatagaaatgaagatggcagagtagatgctgtaagagagttcataaatccagtgatagaaatgtataataatggcaaattggcatttgtagaaaaagaaaatgaagaagagcttttgaaatattttaatttgctggaaaaaggtcaaaaatttgaaagaataagacggtatgatatgataacctacaatagtaaattttactatgtaacaaaaataaacaagaatcacagagttactatacaagaagagtctaagataaaagcagaatcagacaaagttaagtcctcttcaggcaaagagtatactcgtaaggaaaccgaggaattatcacttcaaaaattagcggaattaattagtatataa

SEQ ID NO: 11119 - RNA, 2850 nt, synthetic construct
  misc_feature 1..2850: note = ARMAN Cas9 variant__Candidatus Micrarchaeum sp.__OJT94500.1__Cas9
  source 1..2850: mol_type = other RNA
atgagagactctattactgcacctagatacagctccgctcttgccgccagaataaaggagtttaattctgctttcaagttaggaatcgacctaggaacaaaaaccggcggcgtagcactggtaaaagacaacaaagtgctgctcgctaagacattcctcgattaccataaacaaacactggaggaaaggaggatccatagaagaaacagaaggagcaggctagccaggcggaagaggattgctcggctgcgatcatggatactcagacagaagatttatggcaagcagcttcctgacccatacaaaatcaaaaaaatgcagttgcctaatggtgtacgaaaaggggaaaactggattgacctggtagtttctggacgggacctttcaccagaagccttcgtgcgtgcaataactctgatattccaaaagagagggcaaagatatgaagaagtggccaaagagatagaagaaatgagttacaaggaatttagtactcacataaaagccctgacatccgttactgaagaagaatttactgctctggcagcagagatagaacggaggcaggatgtggttgacacagacaaggaggccgaacgctatacccaattgtctgagttgctctccaaggtctcagaaagcaaatctgaatctaaggacagagcgcagcgtaaggaggatctcggaaaggtggtgaacgctttctgcagtgctcatcgtatcgaagacaaggataaatggtgtaaagaacttatgaaattactagacagaccagtcagacacgctaggttccttaacaaagtactgatacgttgcaatatctgcgatagggcaacccctaagaaatccagacctgacgtgagggaactgctatattttgacacagtaagaaacttcttgaaggctggaagagtggagcaaaacccagacgttattagttactataaaaaaatttatatggatgcagaagtaatcagggtcaaaattctgaataaggaaaagctgactgatgaggacaaaaagcaaaagaggaaattagcgagcgaacttaacaggtacaaaaacaaagaatacgtgactgatgcgcagaagaagatgcaagagcaacttaagacattgctgttcatgaagctgacaggcaggtctagatactgcatggctcatcttaaggaaagggcagcaggcaaagatgtagaagaaggacttcatggcgttgtgcagaaaagacacgacaggaacatagcacagcgcaatcacgacttacgtgtgattaatcttattgagagtctgcttttcgacccaaacaaatcgctctccgatgcaataaggaagaacgggttaatgtatgttactattgaggctccagagccaaagactaagcacgcaaagaaaggcgcagctgtggtaagggatcccagaaagttgaaggagaagttgtttgatgatcaaaacggcgtttgcatatatacgggcttgcagttagacaaattagagataagtaaatacgagaaggaccatatctttccagattcaagggatggaccatctatcagggacaatcttgtactcactacaaaagagataaattcagacaaaggcgataggaccccatgggaatggatgcatgataacccagaaaaatggaaagcgttcgagagaagagtcgcagaattctataagaaaggcagaataaatgagaggaaaagagaactcctattaaacaaaggcactgaataccctggcgataacccgactgagctggcgcggggaggcgcccgtgttaacaactttattactgaatttaatgaccgcctcaaaacgcatggagtccaggaactgcagaccatctttgagcgtaacaaaccaatagtgcaggtagtcaggggtgaagaaacgcagcgtctgcgcagacaatggaatgcactaaaccagaatttcataccactaaaggacagggcaatgtcgttcaaccacgctgaagacgcagccatagcagcaagcatgccaccaaaattctggagggagcagatataccgtactgcgtggcactttggacctagtggaaatgagagaccggactttgctttggcagaattggcgccacaatggaatgacttctttatgactaagggcggtccaataatagcagtgctgggcaaaacgaagtatagttggaagcacagcataattgatgacactatatacaagccattcagcaaaagtgcttactatgttgggatatacaaaaagccgaacgccatcacgtccaatgctataaaagtcttaaggccaaaactcttaaatggcgaacatacaatgtctaagaatgcaaagtattatcatcagaagattggtaatgagcgcttcctcatgaaatctcagaaaggtggatcgataattacagtaaaaccacacgacggaccggaaaaagtgcttcaaatcagccctacatatgaatgcgcagtccttactaagcatgacggtaaaataatagtcaaatttaaaccaataaagccgctacgggacatgtatgcccgcggtgtgattaaagccatggacaaagagcttgaaacaagcctctctagcatgagtaaacacgctaagtacaaggagttacacactcatgatatcatatatctgcctgctacaaagaagcacgtagatggctacttcataataaccaaactaagtgcgaaacatggcataaaagcactccccgaaagcatggttaaagtcaagtatactcaaattgggagtgaaaacaatagtgaagtgaagcttaccaaaccaaaaccagagataactttggatagtgaagatattacaaacatatataatttcacccgctaa

SEQ ID NO: 11120 - RNA, 2961 nt, synthetic construct
  misc_feature 1..2961: note = CasX variant__Deltaproteobacteria bacterium__OGP07438.1__CasX
  source 1..2961: mol_type = other RNA
atggaaaagagaataaacaagatacgaaagaaactatcggccgataatgccacaaagcctgtgagcaggagcggccccatgaaaacactccttgtccgggtcatgacggacgacttgaaaaaaagactggagaagcgtcggaaaaagccggaagttatgccgcaggttatttcaaataacgcagcaaacaatcttagaatgctccttgatgactatacaaagatgaaggaggcgatactacaagtttactggcaggaatttaaggacgaccatgtgggcttgatgtgcaaatttgcccagcctgcttccaaaaaaattgaccagaacaaactaaaaccggaaatggatgaaaaaggaaatctaacaactgccggttttgcatgttctcaatgcggtcagccgctatttgtttataagcttgaacaggtgagtgaaaaaggcaaggcttatacaaattacttcggccggtgtaatgtggccgagcatgagaaattgattcttcttgctcaattaaaacctgaaaaagacagtgacgaagcagtgacatactcccttggcaaattcggccagagggcattggacttttattcaatccacgtaacaaaagaatccacccatccagtaaagcccctggcacagattgcgggcaaccgctatgcaagcggacctgttggcaaggccctttccgatgcctgtatgggcactatagccagttttctttcgaaatatcaagacatcatcatagaacatcaaaaggttgtgaagggtaatcaaaagaggttagagagtctcagggaattggcagggaaagaaaatcttgagtacccatcggttacactgccgccgcagccgcatacgaaagaaggggttgacgcttataacgaagttattgcaagggtacgtatgtgggttaatcttaatctgtggcaaaagctgaagctcagccgtgatgacgcaaaaccgctactgcggctaaaaggattcccatctttccctgttgtggagcggcgtgaaaacgaagttgactggtggaatacgattaatgaagtaaaaaaactgattgacgctaaacgagatatgggacgggtattctggagcggcgttaccgcagaaaagagaaataccatccttgaaggatacaactatctgccaaatgagaatgaccataaaaagagagagggcagtttggaaaaccctaagaagcctgccaaacgccagtttggagacctcttgctgtatcttgaaaagaaatatgccggagactggggaaaggtcttcgatgaggcatgggagaggatagataagaaaatagccggactcacaagccatatagagcgcgaagaagcaagaaacgcggaagacgctcaatccaaagccgtacttacagactggctaagggcaaaggcatcatttgttcttgaaagactgaaggaaatggatgaaaaggaattctatgcgtgtgaaatccaacttcaaaaatggtatggcgatcttcgaggcaacccgtttgccgttgaagctgagaatagagttgttgatataagcgggttttctatcggaagcgatggccattcaatccaatacagaaatctccttgcctggaaatatctggagaacggcaagcgtgaattctatctgttaatgaattatggcaagaaagggcgcatcagatttacagatggaacagatattaaaaagagcggcaaatggcagggactattatatggcggtggcaaggcaaaggttattgatctgactttcgaccccgatgatgaacagttgataatcctgccgctggcctttggcacaaggcaaggccgcgagtttatctggaacgatttgctgagtcttgaaacaggcctgataaagctcgcaaacggaagagttatcgaaaaaacaatctataacaaaaaaatagggcgggatgaaccggctctattcgttgccttaacatttgagcgccgggaagttgttgatccatcaaatataaagcctgtaaaccttataggcgttgaccgcggcgaaaacatcccggcggttattgcattgacagaccctgaaggttgtcctttaccggaattcaaggattcatcagggggcccaacagacatcctgcgaataggagaaggatataaggaaaagcagagggctattcaggcagcaaaggaggtagagcaaaggcgggctggcggttattcacggaagtttgcatccaagtcgaggaacctggcggacgacatggtgagaaattcagcgcgagaccttttttaccatgccgttacccacgatgccgtccttgtctttgaaaacctgagcaggggttttggaaggcagggcaaaaggaccttcatgacggaaagacaatatacaaagatggaagactggctgacagcgaagctcgcatacgaaggtcttacgtcaaaaacctacctttcaaagacgctggcgcaatatacgtcaaaaacatgctccaactgcgggtttactataacgactgccgattatgacgggatgttggtaaggcttaaaaagacttctgatggatgggcaactaccctcaacaacaaagaattaaaagccgaaggccagataacgtattataaccggtataaaaggcaaaccgtggaaaaagaactctccgcagagcttgacaggctttcagaagagtcgggcaataatgatatttctaagtggaccaagggtcgccgggacgaggcattatttttgttaaagaaaagattcagccatcggcctgttcaggaacagtttgtttgcctcgattgcggccatgaagtccacgccgatgaacaggcagccttgaatattgcaaggtcatggctttttctaaactcaaattcaacagaattcaaaagttataaatcgggtaaacagcccttcgttggtgcttggcaggccttttacaaaaggaggcttaaagaggtatggaagcccaacgcctga

SEQ ID NO: 11121 - RNA, 2961 nt, synthetic construct
  misc_feature 1..2961: note = CasX variant__Deltaproteobacteria bacterium__OGP07438.1__CasX
  source 1..2961: mol_type = other RNA
atggagaagcgtattaacaagattcgtaagaagttatcggctgataatgccacaaaacctgtaagccgctcaggacctatgaaaacgcttttagttcgtgttatgacagatgatctgaaaaaacgtcttgagaagcgtcgtaaaaagccggaggtcatgcctcaagtcatttcgaataatgccgccaataatttacgtatgcttcttgatgactatacaaagatgaaagaagcaatcctgcaagtctactggcaagagttcaaagatgatcatgtaggtttgatgtgtaagtttgcacagcccgctagtaaaaagatcgaccaaaacaagttaaagccagagatggacgagaaagggaatcttaccactgccgggttcgcttgctctcaatgcggccaaccgctgttcgtatataagctggagcaagtttcagaaaagggtaaggcatacacaaattatttcggacgttgcaacgtcgctgagcacgagaagcttattcttttagcccagctgaaaccagagaaggactctgatgaagcggttacctactccttgggaaagttcggacagcgcgctcttgacttttattccatccacgtgacaaaggaaagtacacaccccgtcaaaccactggcccaaattgcagggaaccgctacgcgagcgggccagtgggaaaagcattgtcagacgcttgtatgggcacgattgcttcctttcttagtaaataccaggatattatcattgaacatcaaaaggtagttaaggggaaccagaagcgtctggaaagcttacgtgaacttgcagggaaagagaaccttgagtacccatcggtcacattgcctccgcagccgcacacaaaggagggtgtcgatgcttataacgaggtgattgcacgcgtacgcatgtgggtaaatttgaatctgtggcagaagttgaaactgtcgcgtgatgacgccaaacctcttttacgcctgaagggcttcccctcatttccagtcgtagagcgccgtgaaaatgaagtagactggtggaatactatcaacgaagtaaaaaagctgattgacgcgaagcgcgacatgggacgcgtgttttggagcggcgttactgctgaaaagcgcaacaccatccttgaaggatacaactatttacccaacgagaacgatcataaaaagcgcgagggcagtttagagaatccgaagaagccggccaaacgtcagtttggcgaccttttattatacctggaaaagaaatatgcgggtgactggggcaaagtgttcgatgaagcctgggagcgcattgacaagaaaatcgctggtctgacgtcgcacattgagcgcgaggaagctcgtaacgcagaagacgcccaatccaaagcggtcctgacagactggctgcgcgctaaggcgtcctttgttcttgagcgtttaaaagagatggacgaaaaggaattctatgcctgtgagattcaattacaaaagtggtatggtgacttacgcgggaacccctttgctgtagaggctgagaatcgtgtagtggacatttcaggtttcagcatcggatcggatggacattctatccaatatcgtaaccttcttgcatggaaatatttggagaatggtaagcgcgagttctatctgcttatgaactacgggaaaaaaggacgtattcgcttcaccgatggtacagacattaaaaaaagtggcaaatggcaagggttgttatatgggggtggcaaagcaaaggttatcgatttaacgtttgatcccgatgatgagcagctgattatcttgcctttagctttcggaacccgccagggccgtgaatttatctggaacgacttgctttctcttgagacaggacttatcaaacttgcgaatggacgcgtgatcgaaaagactatttacaataaaaagatcggtcgcgatgagccggccctgtttgtcgccttaacattcgagcgtcgcgaagttgttgatccgtcaaatatcaagccggtaaacttaatcggggtcgatcgtggtgaaaatatcccggcagtaatcgctcttacagacccagaaggctgccccttacccgagttcaaggactcatccggcggtccaacagacatccttcgcattggcgaaggatataaagagaaacagcgtgcaatccaggcagcaaaagaagtggaacaacgtcgcgccggaggctacagccgcaaatttgcgtcaaaatcgcgtaacttggcagatgatatggtccgcaacagcgcccgtgatttgttttaccacgcggtgacacatgacgctgttttagtttttgagaacttgtcacgtgggttcggacgtcagggaaaacgcaccttcatgactgagcgccaatacacaaaaatggaagactggttgacggctaaactggcttacgaggggcttactagtaaaacgtatttgtcgaaaactcttgctcagtacacctctaaaacttgttctaactgcgggttcacgattaccacagcggactacgatggcatgctggtacgccttaaaaagacgagcgacgggtgggcaacgacattgaacaataaagaacttaaggccgagggacaaatcacctactataatcgttataagcgccagacggtagaaaaagagttaagcgccgaacttgaccgcctgagcgaggagagtgggaacaacgacatttcaaaatggactaaggggcgccgtgacgaggctttgtttttgctgaagaaacgtttctcccatcgtcccgtacaagagcagttcgtttgcttagattgtggccatgaagttcatgctgatgaacaggctgctttaaatatcgcgcgttcctggttgtttcttaatagtaactcaactgagttcaaatcatataagtcagggaaacagccgtttgtgggagcatggcaggctttttataaacgccgcctgaaggaggtctggaagccgaatgcttga

SEQ ID NO: 11122 - RNA, 2937 nt, synthetic construct
  misc_feature 1..2937: note = CasX variant__Planctomycetes bacterium__OHB99618.1__CasX
  source 1..2937: mol_type = other RNA
atgcaggaaataaaaaggataaataaaatacgaaggagattggtaaaggatagcaacacgaaaaaagccggcaaaaccggccctatgaaaaccttgctcgttcgggttatgacacctgacctgagagaaaggttagagaatcttcgcaaaaagccggaaaacattcctcagcccatttcaaatacttcacgtgcaaatttaaataaactcctcactgactatacggaaatgaagaaagcaatcctgcatgtttattgggaagagttccaaaaagaccctgtcggattgatgagcagggttgcacaaccagcgcccaagaatattgatcagagaaaattgattccggtgaaggacggaaatgagagactaacaagttctggatttgcctgttctcagtgctgtcaacccctctatgtttataagcttgaacaagtgaatgacaagggtaagccccatacaaattactttggccgttgtaatgtctccgagcatgaacgtttgatattgctctcgccgcataaaccggaggcaaatgacgagctagtaacgtattcgttggggaagttcggtcaaagggcattggacttttattcaatccacgtaacaagagaatcgaaccatcctgtaaagccgctagaacagatcggtggcaatagctgcgcaagtggtcccgttggtaaggctttatctgatgcctgtatgggagcagtagccagtttccttacaaagtaccaggacatcatcctcgaacaccaaaaggttataaaaaaaaacgaaaagagattggcaaatctaaaggatatagcaagtgcaaacgggcttgcatttcctaaaatcactcttccaccgcaaccgcatacaaaagaagggattgaagcttataacaatgttgttgctcagatagtgatctgggtaaacctgaatctttggcagaaactcaaaattggcagggatgaggcaaagcccttacagcggcttaagggttttccgtccttccctcttgttgaacgccaggcgaatgaggttgattggtgggatatggtctgtaatgtcaaaaagttgattaacgaaaagaaagaggacgggaaggtcttctggcaaaatcttgctggatataaaaggcaggaagccttgcttccatatctttcgtctgaagaagaccgtaaaaaaggaaaaaagtttgcgcgttatcagtttggtgaccttttgcttcaccttgaaaagaaacacggtgaagattggggcaaagtttatgatgaggcatgggaaagaatagataaaaaagttgaaggtctgagtaagcacataaagttggaggaagaaagaaggtctgaagatgctcaatcaaaggctgccctcactgattggctcagggcaaaggcctcttttgttattgaagggctcaaagaagctgataaggatgagttttgcaggtgtgagttaaagcttcaaaagtggtatggagatttgagaggaaaaccatttgctatagaagcagagaacagcattttagatataagcggattttctaaacagtataattgtgcatttatatggcagaaagacggcgtaaagaagttaaatctttatttaataataaattacttcaaaggtggtaagctacgcttcaaaaaaatcaagccagaagcttttgaagcaaataggttttatacagtaattaataaaaaaagcggtgagattgtgcctatggaggtcaacttcaattttgatgacccgaatttgataattctgcctttggcctttggaaaaaggcaggggagggagtttatctggaacgacctattgagccttgagacgggttcattgaaactcgccaatggcagggttattgaaaaaacgctctataacagaaggacgagacaggatgaaccagcactttttgttgccctgacatttgaaagaagagaggtgcttgactcatcgaatataaaaccgatgaatctgataggaatagaccggggagaaaatatcccggcagtcatagcattaacagacccggaaggatgccccttgtcaagattcaaagattcattgggcaatccaacgcatattttgcgaataggagaaagttataaggaaaaacaacggactattcaggctgctaaagaagttgaacaaaggcgggcaggcggatattcgagaaaatatgcatcaaaggcgaagaatctggcggacgatatggtaagaaatacagctcgtgacctcttatattatgctgttactcaagatgcaatgctcatttttgaaaatctttcccgcggttttggtagacaaggcaagaggacttttatggcggaaaggcagtacacgaggatggaagactggctgactgcaaagcttgcctatgaaggtctgccatcaaaaacctatctttcaaagactctggcacagtatacctcaaagacatgttctaattgtggttttacaatcacaagtgcagattatgacagggtgctcgaaaagctcaagaagacggctactggatggatgactacaatcaatggaaaagagttaaaagttgaaggacagataacatactataaccggtataaaaggcagaatgtggtaaaagacctctctgtagagctggatagactttcggaagagtcggtaaataatgatatttctagttggacaaaaggccgcagtggtgaagctttatctctgctaaaaaagagatttagtcacaggccggtgcaggaaaagtttgtttgcctgaactgtggttttgaaacccatgcagacgaacaagcagcactgaatattgcaaggtcgtggctctttctccgttctcaagaatataagaagtatcaaaccaataaaacgaccggaaatactgacaaaagggcatttgttgaaacatggcaatccttttacagaaagaagctcaaagaagtatggaaaccagccgtctga

SEQ ID NO: 11123 - RNA, 3378 nt, synthetic construct
  misc_feature 1..3378: note = CasY variant__Candidatus Katanobacteria bacterium__OJI08769.1__CasY
  source 1..3378: mol_type = other RNA
atgcgcaaaaaattgtttaagggttacattttacataataagaggcttgtatatacaggtaaagctgcaatacgttctattaaatatccattagtcgctccaaataaaacagccttaaacaatttatcagaaaagataatttatgattatgagcatttattcggacctttaaatgtggctagctatgcaagaaattcaaacaggtacagccttgtggatttttggatagatagcttgcgagcaggtgtaatttggcaaagcaaaagtacttcgctaattgatttgataagtaagctagaaggatctaaatccccatcagaaaagatatttgaacaaatagattttgagctaaaaaataagttggataaagagcaattcaaagatattattcttcttaatacaggaattcgttctagcagtaatgttcgcagtttgagggggcgctttctaaagtgttttaaagaggaatttagagataccgaagaggttatcgcctgtgtagataaatggagcaaggaccttatcgtagagggtaaaagtatactagtgagtaaacagtttctttattgggaagaagagtttggtattaaaatttttcctcattttaaagataatcacgatttaccaaaactaactttttttgtggagccttccttggaatttagtccgcacctccctttagccaactgtcttgagcgtttgaaaaaattcgatatttcgcgtgaaagtttgctcgggttagacaataatttttcggccttttctaattatttcaatgagctttttaacttattgtccaggggggagattaaaaagattgtaacagctgtccttgctgtttctaaatcgtgggagaatgagccagaattggaaaagcgcttacattttttgagtgagaaggcaaagttattagggtaccctaagcttacttcttcgtgggcggattatagaatgattattggcggaaaaattaaatcttggcattctaactataccgaacaattaataaaagttagagaggacttaaagaaacatcaaatcgcccttgataaattacaggaagatttaaaaaaagtagtagatagctctttaagagaacaaatagaagctcaacgagaagctttgcttcctttgcttgataccatgttaaaagaaaaagatttttccgatgatttagagctttacagatttatcttgtcagattttaagagtttgttaaatgggtcttatcaaagatatattcaaacagaagaggagagaaaggaggacagagatgttaccaaaaaatataaagatttatatagtaatttgcgcaacatacctagattttttggggaaagtaaaaaggaacaattcaataaatttataaataaatctctcccgaccatagatgttggtttaaaaatacttgaggatattcgtaatgctctagaaactgtaagtgttcgcaaacccccttcaataacagaagagtatgtaacaaagcaacttgagaagttaagtagaaagtacaaaattaacgcctttaattcaaacagatttaaacaaataactgaacaggtgctcagaaaatataataacggagaactaccaaagatctcggaggttttttatagatacccgagagaatctcatgtggctataagaatattacctgttaaaataagcaatccaagaaaggatatatcttatcttctcgacaaatatcaaattagccccgactggaaaaacagtaacccaggagaagttgtagatttgatagagatatataaattgacattgggttggctcttgagttgtaacaaggatttttcgatggatttttcatcgtatgacttgaaactcttcccagaagccgcttccctcataaaaaattttggctcttgcttgagtggttactatttaagcaaaatgatatttaattgcataaccagtgaaataaaggggatgattactttatatactagagacaagtttgttgttagatatgttacacaaatgataggtagcaatcagaaatttcctttgttatgtttggtgggagagaaacagactaaaaacttttctcgcaactggggtgtattgatagaagagaagggagatttgggggaggaaaaaaaccaggaaaaatgtttgatatttaaggataaaacagattttgctaaagctaaagaagtagaaatttttaaaaataatatttggcgtatcagaacctctaagtaccaaatccaatttttgaataggctttttaagaaaaccaaagaatgggatttaatgaatcttgtattgagcgagcctagcttagtattggaggaggaatggggtgtttcgtgggataaagataaacttttacctttactgaagaaagaaaaatcttgcgaagaaagattatattactcacttccccttaacttggtgcctgccacagattataaggagcaatctgcagaaatagagcaaaggaatacatatttgggtttggatgttggagaatttggtgttgcctatgcagtggtaagaatagtaagggacagaatagagcttctgtcctggggattccttaaggacccagctcttcgaaaaataagagagcgtgtacaggatatgaagaaaaagcaggtaatggcagtattttctagctcttccacagctgtcgcgcgagtacgagaaatggctatacactctttaagaaatcaaattcatagcattgctttggcgtataaagcaaagataatttatgagatatctataagcaattttgagacaggtggtaatagaatggctaaaatataccgatctataaaggtttcagatgtttatagggagagtggtgcggataccctagtttcagagatgatctggggcaaaaagaataagcaaatgggaaaccatatatcttcctatgcgacaagttacacttgttgcaattgtgcaagaaccccttttgaacttgttatagataatgacaaggaatatgaaaagggaggcgacgaatttatttttaatgttggcgatgaaaagaaggtaagggggtttttacaaaagagtctgttaggaaaaacaattaaagggaaggaagtgttgaagtctataaaagagtacgcaaggccgcctataagggaagtcttgcttgaaggagaagatgtagagcagttgttgaagaggagaggaaatagctatatttatagatgccctttttgtggatataaaactgatgcggatattcaagcggcgttgaatatagcttgtaggggatatatttcggataacgcaaaggatgctgtgaaggaaggagaaagaaaattagattacattttggaagttagaaaattgtgggagaagaatggagctgttttgagaagcgccaaatttttatag

SEQ ID NO: 11124 - RNA, 3378 nt, synthetic construct
  misc_feature 1..3378: note = CasY variant__Candidatus Katanobacteria bacterium__OJI08769.1__CasY
  source 1..3378: mol_type = other RNA
atgcgtaagaagctgttcaaaggctacatcctgcacaacaagcgtttggtttacacagggaaagcggctatccgctcgattaagtatcccctggtcgccccaaataagaccgcgttaaataacttgagtgagaaaattatttatgattacgagcacttatttggtcctctgaacgtcgcgtcgtatgcgcgtaattcaaatcgttactccttagttgatttttggattgactctttacgtgctggcgtcatttggcagtcgaaaagcactagtctgattgatttaattagtaagttagagggatcaaagtcaccttcagagaaaatctttgagcagatcgactttgaattgaagaataagctggacaaggaacagtttaaggacatcattcttctgaacacaggcattcgcagctcctctaacgtgcgcagccttcgcggccgttttctgaagtgtttcaaggaagaattccgtgacaccgaagaggttattgcgtgtgtagataagtggtccaaggacctgattgtggaagggaaatcgattttagtttctaagcagtttttgtattgggaggaggaattcggtatcaagatcttccctcattttaaagataaccatgatcttccaaaattgacattcttcgtagaacctagtcttgagtttagcccacatctgccgttagctaattgtttagaacgtttgaagaagtttgatatcagtcgtgaatccctgttggggctggacaacaacttttcggcgttcagcaactatttcaacgagctttttaacctgctttcgcgtggggagatcaaaaaaatcgtgaccgctgtgttggctgtgagcaagtcttgggaaaacgaacccgagttagaaaaacgtttgcacttcttatctgaaaaagcgaaattgctgggctaccctaagcttaccagctcttgggcggactatcgtatgatcatcggagggaaaattaagagttggcattcaaactatacggagcaactgattaaagtccgtgaggacttgaagaaacatcaaatcgctttggacaagctgcaggaagacctgaagaaagtcgttgattcttcattgcgtgagcagattgaggctcaacgtgaggcgctgctgccgctgctggacaccatgcttaaggaaaaagatttttccgatgatcttgaattatatcgttttattttgagtgattttaagtcccttctgaacgggtcctaccagcgctacatccagactgaagaggaacgcaaagaggatcgtgatgtaactaaaaagtataaggacttgtactcaaatcttcgtaatattccccgtttctttggcgagagcaagaaagagcaattcaacaaatttatcaataagagtcttcctaccattgacgtcggtcttaaaattttggaggatatccgtaacgcactggagacagtttccgtgcgcaagcctccgtcaattacggaggagtatgttacaaaacaattagagaagttgtcccgtaaatataaaatcaatgcattcaatagtaaccgttttaaacagatcaccgaacaggtattgcgcaagtacaataatggcgagttgcctaaaatttcggaagtgttctaccgttacccacgtgaatctcatgtcgccattcgtattctgccggtcaaaatctcgaatccccgtaaggacatcagctatttattagataagtaccaaatttcccctgattggaagaactcaaacccgggtgaggttgttgatctgattgagatttataagctgaccctgggctggcttctgtcatgtaataaggatttctctatggacttttcaagctatgatttaaagttattccctgaggctgcgtccttaattaagaactttgggagctgcctttccggttactacttgagtaagatgatctttaactgcattaccagcgaaatcaaggggatgatcacgctgtatactcgcgataaattcgttgttcgttacgttacccaaatgattggctctaaccaaaagttcccccttctttgcttggtgggagaaaaacagacgaagaacttctcgcgcaactggggggtgcttatcgaagagaaaggtgacctgggtgaagaaaagaaccaggagaagtgcctgatcttcaaggataaaactgattttgcaaaggcgaaggaagtggaaatcttcaaaaataacatttggcgcattcgtacctcgaagtatcaaatccagtttttaaaccgcttattcaaaaagacaaaggagtgggacttgatgaacttggtattatcagaaccgtctttagttttagaagaagagtggggcgtttcctgggacaaggacaagttattaccgcttctgaagaaggaaaaatcgtgcgaagaacgcttgtactattctttgccgcttaatctggtcccggcaacggattataaagagcaatcagcagaaatcgaacagcgcaacacttatctgggcctggatgtgggggaatttggggtggcctatgcggttgttcgcatcgttcgcgaccgcattgaattattgagttggggatttttgaaggatcctgcattgcgtaagatccgtgagcgtgtacaggacatgaaaaagaaacaagtgatggcagtgttttcgtcttcctccactgcagtagcccgcgttcgcgagatggcaatccattctctgcgtaatcaaattcatagtatcgcactggcttataaagctaagattatttatgagatttctatttccaattttgaaaccggtggaaaccgtatggcgaaaatttaccgcagtattaaggtttcggatgtctaccgcgaatcgggagcagacacgcttgttagcgaaatgatctggggaaagaaaaataagcagatggggaatcacatttcctcttatgcgactagttatacgtgttgcaattgtgctcgcacgccatttgagttagttatcgataacgataaggaatatgaaaaaggcggtgatgagtttatcttcaacgtcggagatgaaaagaaagtgcgtggctttcttcagaagagcctgttgggcaaaactattaagggtaaggaagtccttaagagtattaaagaatatgcccgccccccgatccgcgaagttttattagagggggaagatgtagaacagttgttgaaacgccgtggtaacagctatatttaccgttgcccattttgtggatacaaaacggatgctgacatccaggcggcgcttaatattgcatgccgtggttacattagcgataatgctaaggatgcagtaaaggagggggagcgcaaattggattacatcctggaggtccgtaagttatgggaaaagaacggggccgtgctgcgttctgcaaagttcctgtga

SEQ ID NO: 11125 - RNA, 3864 nt, synthetic construct
  misc_feature 1..3864: note = CasY variant__Candidatus Kerfeldbacteria bacterium__OGY82221.1__CasY
  source 1..3864: mol_type = other RNA
atgaagagaattctgaacagtctgaaagttgctgccttgagacttctgtttcgaggcaaaggttctgaattagtgaagacagtcaaatatccattggtttccccggttcaaggcgcggttgaagaacttgctgaagcaattcggcacgacaacctgcacctttttgggcagaaggaaatagtggatcttatggagaaagacgaaggaacccaggtgtattcggttgtggatttttggttggataccctgcgtttagggatgtttttctcaccatcagcgaatgcgttgaaaatcacgctgggaaaattcaattctgatcaggtttcaccttttcgtaaggttttggagcagtcacctttttttcttgcgggtcgcttgaaggttgaacctgcggaaaggatactttctgttgaaatcagaaagattggtaaaagagaaaacagagttgagaactatgccgccgatgtggagacatgcttcattggtcagctttcttcagatgagaaacagagtatccagaagctggcaaatgatatctgggatagcaaggatcatgaggaacagagaatgttgaaggcggatttttttgctatacctcttataaaagaccccaaagctgtcacagaagaagatcctgaaaatgaaacggcgggaaaacagaaaccgcttgaattatgtgtttgtcttgttcctgagttgtatacccgaggtttcggctccattgctgattttctggttcagcgacttaccttgctgcgtgacaaaatgagtaccgacacggcggaagattgcctcgagtatgttggcattgaggaagaaaaaggcaatggaatgaattccttgctcggcacttttttgaagaacctgcagggtgatggttttgaacagatttttcagtttatgcttgggtcttatgttggctggcaggggaaggaagatgtactgcgcgaacgattggatttgctggccgaaaaagtcaaaagattaccaaagccaaaatttgccggagaatggagtggtcatcgtatgtttctccatggtcagctgaaaagctggtcgtcgaatttcttccgtctttttaatgagacgcgggaacttctggaaagtatcaagagtgatattcaacatgccaccatgctcattagctatgtggaagagaaaggaggctatcatccacagctgttgagtcagtatcggaagttaatggaacaattaccggcgttgcggactaaggttttggatcctgagattgagatgacgcatatgtccgaggctgttcgaagttacattatgatacacaagtctgtagcgggatttctgccggatttactcgagtctttggatcgagataaggatagggaatttttgctttccatctttcctcgtattccaaagatagataagaagacgaaagagatcgttgcatgggagctaccgggcgagccagaggaaggctatttgttcacagcaaacaaccttttccggaattttcttgagaatccgaaacatgtgccacgatttatggcagagaggattcccgaggattggacgcgtttgcgctcggcccctgtgtggtttgatgggatggtgaagcaatggcagaaggtggtgaatcagttggttgaatctccaggcgccctttatcagttcaatgaaagttttttgcgtcaaagactgcaagcaatgcttacggtctataagcgggatctccagactgagaagtttctgaagctgctggctgatgtctgtcgtccactcgttgattttttcggacttggaggaaatgatattatcttcaagtcatgtcaggatccaagaaagcaatggcagactgttattccactcagtgtcccagcggatgtttatacagcatgtgaaggcttggctattcgtctccgcgaaactcttggattcgaatggaaaaatctgaaaggacacgagcgggaagattttttacggctgcatcagttgctgggaaatctgctgttctggatcagggatgcgaaacttgtcgtgaagctggaagactggatgaacaatccttgtgttcaggagtatgtggaagcacgaaaagccattgatcttcccttggagattttcggatttgaggtgccgatttttctcaatggctatctcttttcggaactgcgccagctggaattgttgctgaggcgtaagtcggtgatgacgtcttacagcgtcaaaacgacaggctcgccaaataggctcttccagttggtttacctacctctaaacccttcagatccggaaaagaaaaattccaacaactttcaggagcgcctcgatacacctaccggtttgtcgcgtcgttttctggatcttacgctggatgcatttgctggcaaactcttgacggatccggtaactcaggaactgaagacgatggccggtttttacgatcatctctttggcttcaagttgccgtgtaaactggcggcgatgagtaaccatccaggatcctcttccaaaatggtggttctggcaaaaccaaagaagggtgttgctagtaacatcggctttgaacctattcccgatcctgctcatcctgtgttccgggtgagaagttcctggccggagttgaagtacctggaggggttgttgtatcttcccgaagatacaccactgaccattgaactggcggaaacgtcggtcagttgtcagtctgtgagttcagtcgctttcgatttgaagaatctgacgactatcttgggtcgtgttggtgaattcagggtgacggcagatcaacctttcaagctgacgcccattattcctgagaaagaggaatccttcatcgggaagacctacctcggtcttgatgctggagagcgatctggcgttggtttcgcgattgtgacggttgacggcgatgggtatgaggtgcagaggttgggtgtgcatgaagatactcagcttatggcgcttcagcaagtcgccagcaagtctcttaaggagccggttttccagccactccgtaagggcacatttcgtcagcaggagcgcattcgcaaaagcctccgcggttgctactggaatttctatcatgcattgatgatcaagtaccgagctaaagttgtgcatgaggaatcggtgggttcatccggtctggtggggcagtggctgcgtgcatttcagaaggatctcaaaaaggctgatgttctgcccaagaagggtggaaaaaatggtgtagacaaaaaaaagagagaaagcagcgctcaggataccttatggggaggagctttctcgaagaaggaagagcagcagatagcctttgaggttcaggcagctggatcaagccagttttgtctgaagtgtggttggtggtttcagttggggatgcgggaagtaaatcgtgtgcaggagagtggcgtggtgctggactggaaccggtccattgtaaccttcctcatcgaatcctcaggagaaaaggtatatggtttcagtcctcagcaactggaaaaaggctttcgtcctgacatcgaaacgttcaaaaaaatggtaagggattttatgagaccccccatgtttgatcgcaaaggtcggccggccgcggcgtatgaaagattcgtactgggacgtcgtcaccgtcgttatcgctttgataaagtttttgaagagagatttggtcgcagtgctcttttcatctgcccgcgggtcgggtgtgggaatttcgatcactccagtgagcagtcagccgttgtccttgcccttattggttacattgctgataaggaagggatgagtggtaagaagcttgtttatgtgaggctggctgaacttatggctgagtggaagctgaagaaactggagagatcaagggtggaagaacagagctcggcacaataa

SEQ ID NO: 11126 - RNA, 3579 nt, synthetic construct
  misc_feature 1..3579: note = CasY variant__Candidatus Komeilibacteria bacterium__OJI06454.1__CasY
  source 1..3579: mol_type = other RNA
atggcagaaagcaagcagatgcaatgccgcaagtgcggcgcaagcatgaagtatgaagtaattggattgggcaagaagtcatgcagatatatgtgcccagattgcggcaatcacaccagcgcgcgcaagattcagaacaagaaaaagcgcgacaaaaagtatggatccgcaagcaaagcgcagagccagaggatagctgtggctggcgcgctttatccagacaaaaaagtgcagaccataaagacctacaaatacccagcggatctgaatggcgaagttcatgacagaggcgtcgcagagaagattgagcaggcgattcaggaagatgagatcggcctgcttggcccgtccagcgaatacgcttgctggattgcttcacaaaaacaaagcgagccgtattcagttgtagatttttggtttgacgcggtgtgcgcaggcggagtattcgcgtattctggcgcgcgcctgctttccacagtcctccagttgagtggcgaggaaagcgttttgcgcgctgctttagcatctagcccgtttgtagatgacattaatttggcgcaagcggaaaagttcctagccgttagccggcgcacaggccaagataagctaggcaagcgcattggagaatgtttcgcggaaggccggcttgaagcgcttggcatcaaagatcgcatgcgcgaattcgtgcaagcgattgatgtggcccaaaccgcgggccagcggttcgcggccaagctaaagatattcggcatcagtcagatgcctgaagccaagcaatggaacaatgattccgggctcactgtatgtattttgccggattattatgtcccggaagaaaaccgcgcggaccagctggttgttttgcttcggcgcttacgcgagatcgcgtattgcatgggaattgaggatgaagcaggatttgagcatctaggcattgaccctggcgctctttccaatttttccaatggcaatccaaagcgaggatttctcggccgcctgctcaataatgacattatagcgctggcaaacaacatgtcagccatgacgccgtattgggaaggcagaaaaggcgagttgattgagcgccttgcatggcttaaacatcgcgctgaaggattgtatttgaaagagccacatttcggcaactcctgggcagaccaccgcagcaggattttcagtcgcattgcgggctggctttccggatgcgcgggcaagctcaagattgccaaggatcagatttcaggcgtgcgtacggatttgtttctgctcaagcgccttctggatgcggtaccgcaaagcgcgccgtcgccggactttattgcttccatcagcgcgctggatcggtttttggaagcggcagaaagcagccaggatccggcagaacaggtacgcgctttgtacgcgtttcatctgaacgcgcctgcggtccgatccatcgccaacaaggcggtacagaggtctgattcccaggagtggcttatcaaggaactggatgctgtagatcaccttgaattcaacaaagcatttccgtttttttcggatacaggaaagaaaaagaagaaaggagcgaatagcaacggagcgccttctgaagaagaatacacggaaacagaatccattcaacaaccagaagatgcagagcaggaagtgaatggtcaagaaggaaatggcgcttcaaagaaccagaaaaagtttcagcgcattcctcgatttttcggggaagggtcaaggagtgagtatcgaattttaacagaagcgccgcaatattttgacatgttctgcaataatatgcgcgcgatctttatgcagctagagagtcagccgcgcaaggcgcctcgtgatttcaaatgctttctgcagaatcgtttgcagaagctttacaagcaaacctttctcaatgctcgcagtaataaatgccgcgcgcttctggaatccgtccttatttcatggggagaattttatacttatggcgcgaatgaaaagaagtttcgtctgcgccatgaagcgagcgagcgcagctcggatccggactatgtggttcagcaggcattggaaatcgcgcgccggcttttcttgttcggatttgagtggcgcgattgctctgctggagagcgcgtggatttggttgaaatccacaaaaaagcaatctcatttttgcttgcaatcactcaggccgaggtttcagttggttcctataactggcttgggaatagcaccgtgagccggtatctttcggttgctggcacagacacattgtacggcactcaactggaggagtttttgaacgccacagtgctttcacagatgcgtgggctggcgattcggctttcatctcaggagttaaaagacggatttgatgttcagttggagagttcgtgccaggacaatctccagcatctgctggtgtatcgcgcttcgcgcgacttggctgcgtgcaaacgcgctacatgcccggctgaattggatccgaaaattcttgttctgccggctggtgcgtttatcgcgagcgtaatgaaaatgattgagcgtggcgatgaaccattagcaggcgcgtatttgcgtcatcggccgcattcattcggctggcagatacgggttcgtggagtggcggaagtaggcatggatcagggcacagcgctagcattccagaagccgactgaatcagagccgtttaaaataaagccgttttccgctcaatacggcccagtactttggcttaattcttcatcctatagccagagccagtatctggatggatttttaagccagccaaagaattggtctatgcgggtgctacctcaagccggatcagtgcgcgtggaacagcgcgttgctctgatatggaatttgcaggcaggcaagatgcggctggagcgctctggagcgcgcgcgtttttcatgccagtgccattcagcttcaggccgtctggttcaggagatgaagcagtattggcgccgaatcggtacttgggactttttccgcattccggaggaatagaatacgcggtggtggatgtattagattccgcgggtttcaaaattcttgagcgcggtacgattgcggtaaatggcttttcccagaagcgcggcgaacgccaagaggaggcacacagagaaaaacagagacgcggaatttctgatataggccgcaagaagccggtgcaagctgaagttgacgcagccaatgaattgcaccgcaaatacaccgatgttgccactcgtttagggtgcagaattgtggttcagtgggcgccccagccaaagccgggcacagcgccgaccgcgcaaacagtatacgcgcgcgcagtgcggaccgaagcgccgcgatctggaaatcaagaggatcatgctcgtatgaaatcctcttggggatatacctggagcacctattgggagaagcgcaaaccagaggatattttgggcatctcaacccaagtatactggaccggcggtataggcgagtcatgtcccgcagtcgcggttgcgcttttggggcacattagggcaacatccactcaaactgaatgggaaaaagaggaggttgtattcggtcgactgaagaagttctttccaagctag

SEQ ID NO: 11127 - RNA, 3633 nt, synthetic construct
  misc_feature 1..3633: note = CasY variant__Candidatus Parcubacteria bacterium__APG80656.1__CasY
  source 1..3633: mol_type = other RNA
atgagtaagcgacatcctagaattagcggcgtaaaagggtaccgtttgcatgcgcaacggctggaatataccggcaaaagtggggcaatgcgaacgattaaatatcctctttattcatctccgagcggtggaagaacggttccgcgcgagatagtttcagcaatcaatgatgattatgtagggctgtacggtttgagtaattttgacgatctgtataatgcggaaaagcgcaacgaagaaaaggtctactcggttttagatttttggtacgactgcgtccaatacggcgcggttttttcgtatacagcgccgggtcttttgaaaaatgttgccgaagttcgcgggggaagctacgaacttacaaaaacgcttaaagggagccatttatatgatgaattgcaaattgataaagtaattaaatttttgaataaaaaagaaatttcgcgagcaaacggatcgcttgataaactgaagaaagacatcattgattgcttcaaagcagaatatcgggaacgacataaagatcaatgcaataaactggctgatgatattaaaaatgcaaaaaaagacgcgggagcttctttaggggagcgtcaaaaaaaattatttcgcgatttttttggaatttcagagcagtctgaaaatgataaaccgtcttttactaatccgctaaacttaacctgctgtttattgccttttgacacagtgaataacaacagaaaccgcggcgaagttttgtttaacaagctcaaggaatatgctcaaaaattggataaaaacgaagggtcgcttgaaatgtgggaatatattggcatcgggaacagcggcactgccttttctaattttttaggagaagggtttttgggcagattgcgcgagaataaaattacagagctgaaaaaagccatgatggatattacagatgcatggcgtgggcaggaacaggaagaagagttagaaaaacgtctgcggatacttgccgcgcttaccataaaattgcgcgagccgaaatttgacaaccactggggagggtatcgcagtgatataaacggcaaattatctagctggcttcagaattacataaatcaaacagtcaaaatcaaagaggacttaaagggacacaaaaaggacctgaaaaaagcgaaagagatgataaataggtttggggaaagcgacacaaaggaagaggcggttgtttcatctttgcttgaaagcattgaaaaaattgttcctgatgatagcgctgatgacgagaaacccgatattccagctattgctatctatcgccgctttctttcggatggacgattaacattgaatcgctttgtccaaagagaagatgtgcaagaggcgctgataaaagaaagattggaagcggagaaaaagaaaaaaccgaaaaagcgaaaaaagaaaagtgacgctgaagatgaaaaagaaacaattgacttcaaggagttatttcctcatcttgccaaaccattaaaattggtgccaaacttttacggcgacagtaagcgtgagctgtacaagaaatataagaacgccgctatttatacagatgctctgtggaaagcagtggaaaaaatatacaaaagcgcgttctcgtcgtctctaaaaaattcattttttgatacagattttgataaagatttttttattaagcggcttcagaaaattttttcggtttatcgtcggtttaatacagacaaatggaaaccgattgtgaaaaactctttcgcgccctattgcgacatcgtctcacttgcggagaatgaagttttgtataaaccgaaacagtcgcgcagtagaaaatctgccgcgattgataaaaacagagtgcgtctcccttccactgaaaatatcgcaaaagctggcattgccctcgcgcgggagctttcagtcgcaggatttgactggaaagatttgttaaaaaaagaggagcatgaagaatacattgatctcatagaattgcacaaaaccgcgcttgcgcttcttcttgccgtaacagaaacacagcttgacataagcgcgttggattttgtagaaaatgggacggtcaaggattttatgaaaacgcgggacggcaatctggttttggaagggcgtttccttgaaatgttctcgcagtcaattgtgttttcagaattgcgcgggcttgcgggtttaatgagccgcaaggaatttatcactcgctccgcgattcaaactatgaacggcaaacaggcggagcttctctacattccgcatgaattccaatcggcaaaaattacaacgccaaaggaaatgagcagggcgtttcttgaccttgcgcccgcggaatttgctacatcgcttgagccagaatcgctttcggagaagtcattattgaaattgaagcagatgcggtactatccgcattattttggatatgagcttacgcgaacaggacaggggattgatggtggagtcgcggaaaatgcgttacgacttgagaagtcgccagtaaaaaaacgagagataaaatgcaaacagtataaaactttgggacgcggacaaaataaaatagtgttatatgtccgcagttcttattatcagacgcaatttttggaatggtttttgcatcggccgaaaaacgttcaaaccgatgttgcggttagcggttcgtttcttatcgacgaaaagaaagtaaaaactcgctggaattatgacgcgcttacagtcgcgcttgaaccagtttccggaagcgagcgggtctttgtctcacagccgtttactatttttccggaaaaaagcgcagaggaagaaggacagaggtatcttggcatagacatcggcgaatacggcattgcgtatactgcgcttgagataactggcgacagtgcaaagattcttgatcaaaattttatttcagacccccagcttaaaactctgcgcgaggaggtcaaaggattaaaacttgaccaaaggcgcgggacatttgccatgccaagcacgaaaatcgcccgcatccgcgaaagccttgtgcatagtttgcggaaccgcatacatcatcttgcgttaaagcacaaagcaaagattgtgtatgaattggaagtgtcgcgttttgaagagggaaagcaaaaaattaagaaagtctacgctacgttaaaaaaagcggatgtgtattcagaaattgacgcggataaaaatttacaaacgacagtatggggaaaattggccgttgcaagcgaaatcagcgcaagctatacaagccagttttgtggtgcgtgtaaaaaattgtggcgggcggaaatgcaggttgacgaaacaattacaacccaagaactaatcggcacagttagagtcataaaagggggcactcttattgacgcgataaaggattttatgcgcccgccgatttttgacgaaaatgacactccatttccaaaatatagagacttttgcgacaagcatcacatttccaaaaaaatgcgtggaaacagctgtttgttcatttgtccattctgccgcgcaaacgcggatgctgatattcaagcaagccaaacaattgcgcttttaaggtatgttaaggaagagaaaaaggtagaggactactttgaacgatttagaaagctaaaaaacattaaagtgctcggacagatgaagaaaatatga

SEQ ID NO: 11128 - RNA, 3681 nt, synthetic construct
  misc_feature 1..3681: note = CasY variant__Candidatus Vogelbacteria bacterium__OJI07455.1__CasY
  source 1..3681: mol_type = other RNA
atgcaaaaagtaagaaaaactttatcagaggtacataaaaatccttatggtacaaaagtccgtaatgcaaagactggctactcactacagatagagaggctttcgtatactggaaaagaggggatgagaagttttaagattccactcgaaaataaaaataaagaagtttttgatgaattcgtaaaaaagatcaggaatgattatatcagtcaggttgggttgctcaatctttctgattggtatgaacattatcaggagaaacaagaacattattctttggcggatttttggttagatagtttgagggccggagtgatttttgcgcacaaagaaactgagataaagaatcttatctctaagatacgtggtgataaatcgattgttgataaatttaatgcaagtataaagaaaaaacacgccgatctttatgcccttgtcgatataaaagctctctacgattttcttacctccgacgcaagaaggggattaaagaccgaagaagaattttttaactcaaaaaggaataccttgtttccgaaatttagaaaaaaagataacaaagccgtcgacctttgggtcaaaaaatttattgggctggataataaagacaaattaaattttaccaaaaagtttatcggtttcgatccaaatcctcagattaaatatgaccatactttcttctttcatcaagacattaattttgatctagagagaatcacgactccgaaggaacttatttcgacttataagaaattcttaggaaaaaataaggatctatacggttctgatgaaacaacggaagatcaacttaaaatggtattaggttttcataataatcacggcgctttttctaagtatttcaacgcgagcttggaagcttttagggggagagacaactccttggttgaacaaataattaataattctccttactggaatagccatcggaaagaattggaaaagagaatcatttttttgcaagttcagtctaaaaaaataaaagagaccgaactgggaaagcctcacgagtatcttgcgagttttggcgggaagtttgaatcttgggtttcaaactatttacgtcaggaagaagaggtcaaacgtcaactttttggttatgaggagaataaaaaaggccagaaaaaatttatcgtgggcaacaaacaagagctagataaaatcatcagagggacagatgagtatgagattaaagcgatttctaaggaaaccattggacttactcagaaatgtttaaaattacttgaacaactaaaagatagtgtcgatgattatacacttagcctatatcggcaactcatagtcgaattgagaatcagactgaatgttgaattccaagaaacttatccggaattaatcggtaagagtgagaaagataaagaaaaagatgcgaaaaataaacgggcagacaagcgttacccgcaaatttttaaggatataaaattaatccccaattttctcggtgaaacgaaacaaatggtatataagaaatttattcgttccgctgacatcctttatgaaggaataaattttatcgaccagatcgataaacagattactcaaaatttgttgccttgttttaagaacgacaaggaacggattgaatttaccgaaaaacaatttgaaactttacggcgaaaatactatctgatgaatagttcccgttttcaccatgttattgaaggaataatcaataataggaaacttattgaaatgaaaaagagagaaaatagcgagttgaaaactttctccgatagtaagtttgttttatctaagctttttcttaaaaaaggcaaaaaatatgaaaatgaggtctattatactttttatataaatccgaaagctcgtgaccagcgacggataaaaattgttcttgatataaatgggaacaattcagtcggaattttacaagatcttgtccaaaagttgaaaccaaaatgggacgacatcataaagaaaaatgatatgggagaattaatcgatgcaatcgagattgagaaagtccggctcggcatcttgatagcgttatactgtgagcataaattcaaaattaaaaaagaactcttgtcattagatttgtttgccagtgcctatcaatatctagaattggaagatgaccctgaagaactttctgggacaaacctaggtcggtttttacaatccttggtctgctccgaaattaaaggtgcgattaataaaataagcaggacagaatatatagagcggtatactgtccagccgatgaatacggagaaaaactatcctttactcatcaataaggagggaaaagccacttggcatattgctgctaaggatgacttgtccaagaagaagggtgggggcactgtcgctatgaatcaaaaaatcggcaagaatttttttgggaaacaagattataaaactgtgtttatgcttcaggataagcggtttgatctactaacctcaaagtatcacttgcagtttttatctaaaactcttgatactggtggagggtcttggtggaaaaacaaaaatattgatttaaatttaagctcttattctttcattttcgaacaaaaagtaaaagtcgaatgggatttaaccaatcttgaccatcctataaagattaagcctagcgagaacagtgatgatagaaggcttttcgtatccattccttttgttattaaaccgaaacagacaaaaagaaaggatttgcaaactcgagtcaattatatggggattgatatcggagaatatggtttggcttggacaattattaatattgatttaaagaataaaaaaataaataagatttcaaaacaaggtttcatctatgagccgttgacacataaagtgcgcgattatgttgctaccattaaagataatcaggttagaggaacttttggcatgcctgatacgaaactagccagattgcgagaaaatgccattaccagcttgcgcaatcaagtgcatgatattgctatgcgctatgacgccaaaccggtatatgaatttgaaatttccaattttgaaacggggtctaataaagtgaaagtaatttatgattcggttaagcgagctgatatcggccgaggccagaataataccgaagcagacaatactgaggttaatcttgtctgggggaagacaagcaaacaatttggcagtcaaatcggcgcttatgcgacaagttacatctgttcattttgtggttattctccatattatgaatttgaaaattctaagtcgggagatgaagaaggggctagagataatctatatcagatgaagaaattgagtcgcccctctcttgaagatttcctccaaggaaatccggtttataagacatttagggattttgataagtataaaaacgatcaacggttgcaaaagacgggtgataaagatggtgaatggaaaacacacagagggaatactgcaatatacgcctgtcaaaagtgtagacatatctctgatgcggatatccaagcatcatattggattgctttgaagcaagttgtaagagatttttataaagacaaagagatggatggtgatttgattcaaggagataataaagacaagagaaaagtaaacgagcttaatagacttattggagtacataaagatgtgcctataataaataaaaatttaataacatcactcgacataaacttactatag

SEQ ID NO: 11129 - RNA, 3603 nt, synthetic construct
  misc_feature 1..3603: note = CasY variant__Candidatus Vogelbacteria bacterium__OJI09436.1__CasY
  source 1..3603: mol_type = other RNA
atgaaagctaaaaaaagtttttataatcaaaagcggaagttcggtaaaagaggttatcgtcttcacgatgaacgtatcgcgtattcaggagggattggatcgatgcgatctattaaatatgaattgaaggattcgtatggaattgctgggcttcgtaatcgaatcgctgacgcaactatttctgataataagtggctgtacgggaatataaatctaaatgattatttagagtggcgatcttcaaagactgacaaacagattgaagacggagaccgagaatcatcactcctgggtttttggctggaagcgttacgactgggattcgtgttttcaaaacaatctcatgctccgaatgattttaacgagaccgctctacaagatttgtttgaaactcttgatgatgatttgaaacatgttcttgataggaaaaaatggtgtgactttatcaagataggaacacctaagacaaatgaccaaggtcgtttaaaaaaacaaatcaagaatttgttaaaaggaaacaagagagaggaaattgaaaaaactctcaatgaatcagacgatgaattgaaagagaaaataaacagaattgccgatgtttttgcaaaaaataagtctgataaatacacaattttcaaattagataaacccaatacggaaaaataccccagaatcaacgatgttcaggtggcgtttttttgtcatcccgattttgaggaaattacagaacgagatagaacaaagactctagatctgatcattaatcggtttaataagagatatgaaattaccgaaaataaaaaagatgacaaaacttcaaacaggatggccttgtattccttgaaccagggctatattcctcgcgtcctgaatgatttattcttgtttgtcaaagacaatgaggatgattttagtcagtttttatctgatttggagaatttcttctctttttccaacgaacaaattaaaataataaaggaaaggttaaaaaaacttaaaaaatatgctgaaccaattcccggaaagccgcaacttgctgataaatgggacgattatgcttctgattttggcggtaaattggaaagctggtactccaatcgaatagagaaattaaagaagattccggaaagcgtttccgatctgcggaataatttggaaaagatacgcaatgttttaaaaaaacaaaataatgcatctaaaatcctggagttatctcaaaagatcattgaatacatcagagattatggagtttcttttgaaaagccggagataattaagttcagctggataaataagacgaaggatggtcagaaaaaagttttctatgttgcgaaaatggcggatagagaattcatagaaaagcttgatttatggatggctgatttacgcagtcaattaaatgaatacaatcaagataataaagtttctttcaaaaagaaaggtaaaaaaatagaagagctcggtgtcttggattttgctcttaataaagcgaaaaaaaataaaagtacaaaaaatgaaaatggctggcaacaaaaattgtcagaatctattcaatctgccccgttattttttggcgaagggaatcgtgtacgaaatgaagaagtttataatttgaaggaccttctgttttcagaaatcaagaatgttgaaaatattttaatgagctcggaagcggaagacttaaaaaatataaaaattgaatataaagaagatggcgcgaaaaaagggaactatgtcttgaatgtcttggctagattttacgcgagattcaatgaggatggctatggtggttggaacaaagtaaaaaccgttttggaaaatattgcccgagaggcggggactgatttttcaaaatatggaaataataacaatagaaatgccggcagattttatctaaacggccgcgaacgacaagtttttactctaatcaagtttgaaaaaagtatcacggtggaaaaaatacttgaattggtaaaattacctagcctacttgatgaagcgtatagagatttagtcaacgaaaataaaaatcataaattacgcgacgtaattcaattgagcaagacaattatggctctggttttatctcattctgataaagaaaaacaaattggaggaaattatatccatagtaaattgagcggatacaatgcgcttatttcaaagcgagattttatctcgcggtatagcgtgcaaacgaccaacggaactcaatgtaaattagccataggaaaaggcaaaagcaaaaaaggtaatgaaattgacaggtatttctacgcttttcaattttttaagaatgacgacagcaaaattaatttaaaggtaatcaaaaataattcgcataaaaacatcgatttcaacgacaatgaaaataaaattaacgcattgcaagtgtattcatcaaactatcagattcaattcttagactggttttttgaaaaacatcaagggaagaaaacatcgctcgaggtcggcggatcttttaccatcgccgaaaagagtttgacaatagactggtcggggagtaatccgagagtcggttttaaaagaagcgacacggaagaaaagagggtttttgtctcgcaaccatttacattaataccagacgatgaagacaaagagcgtcgtaaagaaagaatgataaagacgaaaaaccgttttatcggtatcgatatcggtgaatatggtctggcttggagtctaatcgaagtggacaatggagataaaaataatagaggaattagacaacttgagagcggttttattacagacaatcagcagcaagtcttaaagaaaaacgtaaaatcctggaggcaaaaccaaattcgtcaaacgtttacttcaccagacacaaaaattgctcgtcttcgtgaaagtttgatcggaagttacaaaaatcaactggaaagtctgatggttgctaaaaaagcaaatcttagttttgaatacgaagtttccgggtttgaagttgggggaaagagggttgcaaaaatatacgatagtataaagcgtgggtcggtgcgtaaaaaggataataactcacaaaatgatcaaagttggggtaaaaagggaattaatgagtggtcattcgagacgacggctgccggaacatcgcaattttgtactcattgcaagcggtggagcagtttagcgatagtagatattgaagaatatgaattaaaagattacaacgataatttatttaaggtaaaaattaatgatggtgaagttcgtctccttggtaagaaaggttggagatccggcgaaaagatcaaagggaaagaattatttggtcccgtcaaagacgcaatgcgcccaaatgttgacggactagggatgaaaattgtaaaaagaaaatatctaaaacttgatctccgcgattgggtttcaagatatgggaatatggctattttcatctgtccttatgtcgattgccaccatatctctcatgcggataaacaagctgcttttaatattgccgtgcgagggtatttgaaaagcgttaatcctgacagagcaataaaacacggagataaaggtttgtctagggactttttgtgccaagaagagggtaagcttaattttgaacaaatagggttattatga

SEQ ID NO: 11130 - RNA, 3462 nt, synthetic construct
  misc_feature 1..3462: note = CasY variant__Candidatus Vogelbacteria bacterium__PIP58309.1__CasY
  source 1..3462: mol_type = other RNA
atgcaaaaagtaagaaaaactttatcagaggtacataaaaatccttatggtacaaaagtccgtaatgcaaagactggctactcactacagatagagaggctttcgtatactggaaaagaggggatgagaagttttaagattccactcgaaaataaaaataaagaagtttttgatgaattcgtaaaaaagatcaggaatgattatatcagtcaggttgggttgctcaatctttctgattggtatgaacattatcaggagaaacaagaacattattctttggcggatttttggttagatagtttgagggccggagtgatttttgcgcacaaagaaactgagataaagaatcttatctctaagatacgtggtgataaatcgattgttgataaatttaatgcaagtataaagaaaaaacacgccgatctttatgcccttgtcgatataaaagctctctacgattttcttacctccgacgcaagaaggggattaaagaccgaagaagaattttttaactcaaaaaggaataccttgtttccgaaatttagaaaaaaagataacaaagccgtcgacctttgggtcaaaaaatttattgggctggataataaagacaaattaaattttaccaaaaagtttatcggtttcgatccaaatcctcagattaaatatgaccatactttcttctttcatcaagacattaattttgatctagagagaatcacgactccgaaggaacttatttcgacttataagaaattcttaggaaaaaataaggatctatacggttctgatgaaacaacggaagatcaacttaaaatggtattaggttttcataataatcacggcgctttttctaagtatttcaacgcgagcttggaagcttttagggggagagacaactccttggttgaacaaataattaataattctccttactggaatagccatcggaaagaattggaaaagagaatcatttttttgcaagttcagtctaaaaaaataaaagagaccgaactgggaaagcctcacgagtatcttgcgagttttggcgggaagtttgaatcttgggtttcaaactatttacgtcaggaagaagaggtcaaacgtcaactttttggttatgaggagaataaaaaaggccagaaaaaatttatcgtgggcaacaaacaagagctagataaaatcatcagagggacagatgagtatgagattaaagcgatttctaaggaaaccattggacttactcagaaatgtttaaaattacttgaacaactaaaagatagtgtcgatgattatacacttagcctatatcggcaactcatagtcgaattgagaatcagactgaatgttgaattccaagaaacttatccggaattaatcggtaagagtgagaaagataaagaaaaagatgcgaaaaataaacgggcagacaagcgttacccgcaaatttttaaggatataaaattaatccccaattttctcggtgaaacgaaacaaatggtatataagaaatttattcgttccgctgacatcctttatgaaggaataaattttatcgaccagatcgataaacagattactcaaaatttgttgccttgttttaagaacgacaaggaacggattgaatttaccgaaaaacaatttgaaactttacggcgaaaatactatctgatgaatagttcccgttttcaccatgttattgaaggaataatcaataataggaaacttattgaaatgaaaaagagagaaaatagcgagttgaaaactttctccgatagtaagtttgttttatctaagctttttcttaaaaaaggcaaaaaatatgaaaatgaggtctattatactttttatataaatccgaaagctcgtgaccagcgacggataaaaattgttcttgatataaatgggaacaattcagtcggaattttacaagatcttgtccaaaagttgaaaccaaaatgggacgacatcataaagaaaaatgatatgggagaattaatcgatgcaatcgagattgagaaagtccggctcggcatcttgatagcgttatactgtgagcataaattcaaaattaaaaaagaactcttgtcattagatttgtttgccagtgcctatcaatatctagaattggaagatgaccctgaagaactttctgggacaaacctaggtcggtttttacaatccttggtctgctccgaaattaaaggtgcgattaataaaataagcaggacagaatatatagagcggtatactgtccagccgatgaatacggagaaaaactatcctttactcatcaataaggagggaaaagccacttggcatattgctgctaaggatgacttgtccaagaagaagggtgggggcactgtcgctatgaatcaaaaaatcggcaagaatttttttgggaaacaagattataaaactgtgtttatgcttcaggataagcggtttgatctactaacctcaaagtatcacttgcagtttttatctaaaactcttgatactggtggagggtcttggtggaaaaacaaaaatattgatttaaatttaagctcttattctttcattttcgaacaaaaagtaaaagtcgaatgggatttaaccaatcttgaccatcctataaagattaagcctagcgagaacagtgatgatagaaggcttttcgtatccattccttttgttattaaaccgaaacagacaaaaagaaaggatttgcaaactcgagtcaattatatggggattgatatcggagaatatggtttggcttggacaattattaatattgatttaaagaataaaaaaataaataagatttcaaaacaaggtttcatctatgagccgttgacacataaagtgcgcgattatgttgctaccattaaagataatcaggttagaggaacttttggcatgcctgatacgaaactagccagattgcgagaaaatgccattaccagcttgcgcaatcaagtgcatgatattgctatgcgctatgacgccaaaccggtatatgaatttgaaatttccaattttgaaacggggtctaataaagtgaaagtaatttatgattcggttaagcgagctgatatcggccgaggccagaataataccgaagcagacaatactgaggttaatcttgtctgggggaagacaagcaaacaatttggcagtcaaatcggcgcttatgcgacaagttacatctgttcattttgtggttattctccatattatgaatttgaaaattctaagtcgggagatgaagaaggggctagagataatctatatcagatgaagaaattgagtcgcccctctcttgaagatttcctccaaggaaatccggtttataagacatttagggattttgataagtataaaaacgatcaacggttgcaaaagacgggtgataaagatggtgaatggaaaacacacagagggaatactgcaatatacgcctgtcaaaagtgttga

SEQ ID NO: 11131 - RNA, 3480 nt, synthetic construct
  misc_feature 1..3480: note = Cas13a variant__Leptotrichia buccalis__WP_015770004.1__Cas13a
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctgcgcaagctcctgagctacgaccgcaagctgaagaacgccgtgatgaagtccgtggtcgacatcctcaaggagtacgggttcgtggcgacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11132 - RNA, 3480 nt, synthetic construct
  misc_feature 1..3480: note = Cas13a variant__Leptotrichia buccalis__WP_015770004.1__Cas13a(R472A,H477A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatcgcccacggcatcgtggcgttcaacctcgagctggaggggaaggacatcttcgccttcaagaacatcgccccctccgagatcagcaagaagatgttccagaacgagatcaacgagaagaagctgaagctcaagatcttccgccagctgaactccgccaacgtcttccgctacctggagaagtacaagatcctcaactacctgaagcggacccgcttcgagttcgtgaacaagaacatccccttcgtccccagcttcacgaagctgtactcccggatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcgcaacctgaagacgggcttctacaagctccagaagttcgaggacatccaggagaagatccccaaggagtacctggcgaacatccagtccctgtacatgatcaacgccgggaaccaggacgaggaggagaaggacacctacatcgacttcatccagaagatcttcctcaagggcttcatgacctacctggccaacaacgggcggctgagcctcatctacatcggctccgacgaggagaccaacacgagcctggccgagaagaagcaggagttcgacaagttcctgaagaagtacgagcagaacaacaacatcaagatcccctacgagatcaacgagttcctccgcgagatcaagctggggaacatcctgaagtacaccgagcggctcaacatgttctacctgatcctgaagctcctgaaccacaaggagctgaccaacctcaagggcagcctggagaagtaccagtccgccaacaaggaggaggcgttcagcgaccagctggagctcatcaacctgctgaacctcgacaacaaccgcgtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgggccttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccgcaagtacgcgcggccccgcaaggacgagaagttcaccgacgaggactacgagtcctacaagcaggccatcgagaacatcgaggagtacacccacctcaagaacaaggtcgagttcaacgagctgaacctgctccaggggctgctgctccggatcctgcaccgcctggtgggctacaccagcatctgggagcgggacctccgcttccggctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgccaacatcaaggtgctcaagcaggagaagaaggacctgtacatccgcaactacatcgcccacttcaactacatcccccacgcggagatctccctgctcgaggtcctggagaacctgcggaagctcctgagctacgaccgcaagctgaagaacgccgtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccgcaactccgaggagctgtgcaagctcgtcaagatcatgttcgagtacaagatggaggagaagaagtccgagaactga

SEQ ID NO: 11133 - RNA, 3480 nt, synthetic construct
  misc_feature 1..3480: note = Cas13a variant__Leptotrichia buccalis__WP_015770004.1__Cas13a(R1048A,H1053A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatcgccaactacatcgccgccttcaactacatcccccacgcggagatctccctgctcgaggtcctggagaacctgcggaagctcctgagctacgaccgcaagctgaagaacgccgtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccgcaactccgaggagctgtgcaagctcgtcaagatcatgttcgagtacaagatggaggagaagaagtccgagaactga

SEQ ID NO: 11134 - RNA, 3480 nt, synthetic construct
  misc_feature 1..3480: note = Cas13a variant__Leptotrichia buccalis__WP_015770004.1__Cas13a(R472A,H477A,R1048A,H1053A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatcgcccacggcatcgtggcgttcaacctcgagctggaggggaaggacatcttcgccttcaagaacatcgccccctccgagatcagcaagaagatgttccagaacgagatcaacgagaagaagctgaagctcaagatcttccgccagctgaactccgccaacgtcttccgctacctggagaagtacaagatcctcaactacctgaagcggacccgcttcgagttcgtgaacaagaacatccccttcgtccccagcttcacgaagctgtactcccggatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcgcaacctgaagacgggcttctacaagctccagaagttcgaggacatccaggagaagatccccaaggagtacctggcgaacatccagtccctgtacatgatcaacgccgggaaccaggacgaggaggagaaggacacctacatcgacttcatccagaagatcttcctcaagggcttcatgacctacctggccaacaacgggcggctgagcctcatctacatcggctccgacgaggagaccaacacgagcctggccgagaagaagcaggagttcgacaagttcctgaagaagtacgagcagaacaacaacatcaagatcccctacgagatcaacgagttcctccgcgagatcaagctggggaacatcctgaagtacaccgagcggctcaacatgttctacctgatcctgaagctcctgaaccacaaggagctgaccaacctcaagggcagcctggagaagtaccagtccgccaacaaggaggaggcgttcagcgaccagctggagctcatcaacctgctgaacctcgacaacaaccgcgtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgggccttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccgcaagtacgcgcggccccgcaaggacgagaagttcaccgacgaggactacgagtcctacaagcaggccatcgagaacatcgaggagtacacccacctcaagaacaaggtcgagttcaacgagctgaacctgctccaggggctgctgctccggatcctgcaccgcctggtgggctacaccagcatctgggagcgggacctccgcttccggctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgccaacatcaaggtgctcaagcaggagaagaaggacctgtacatcgccaactacatcgcggccttcaactacatcccccacgccgagatctccctgctcgaggtcctggagaacctgcgcaagctcctgagctacgaccggaagctgaagaacgccgtgatgaagtccgtggtcgacatcctcaaggagtacgggttcgtggccacgttcaagatcggcgcggacaagaagatcgggatccagaccctggagagcgagaagatcgtgcacctgaagaacctcaagaagaagaagctgatgaccgaccgcaactccgaggagctgtgcaagctcgtcaagatcatgttcgagtacaagatggaggagaagaagtccgagaactga

SEQ ID NO: 11135 - RNA, 3480 nt, synthetic construct
  misc_feature 1..3480: note = Cas13a variant__Leptotrichia buccalis__WP_015770004.1__Cas13a(R1079A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctgcgcaagctcctgagctacgacgccaagctgaagaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccgcaactccgaggagctgtgcaagctcgtcaagatcatgttcgagtacaagatggaggagaagaagtccgagaactga

SEQ ID NO: 11136 - RNA, 3480 nt, synthetic construct
  misc_feature 1..3480: note = Cas13a variant__Leptotrichia buccalis__WP_015770004.1__Cas13a(E299A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgccatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcgcgcaaccggcagaacgaggccttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgcgttcaagaacatcgccccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgcggggaaccaggacgaggaggagaaggacacctacatcgacttcatccagaagatcttcctcaagggcttcatgacctacctggccaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggcggacgagatcggcaagttcctggacttcaacgggaacaaggtgaaggacaacaaggagctcaagaagttcgacacgaacaagatctacttcgacggcgagaacatcatcaagcaccgcgccttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggcgatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgccaacatcaaggtgctcaagcaggagaagaaggacctgtacatccggaactacatcgcccacttcaactacatcccccacgccgagatctccctgctcgaggtcctggagaacctgcgcaagctcctgagctacgaccgcaagctgaagaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11137 - RNA, 3480 nt, synthetic construct
  misc_feature 1..3480: note = Cas13a variant__Leptotrichia buccalis__WP_015770004.1__Cas13a(K310A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacgcccggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcgcgcaaccggcagaacgaggccttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgcgttcaagaacatcgccccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgcggggaaccaggacgaggaggagaaggacacctacatcgacttcatccagaagatcttcctcaagggcttcatgacctacctggccaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggcggacgagatcggcaagttcctggacttcaacgggaacaaggtgaaggacaacaaggagctcaagaagttcgacacgaacaagatctacttcgacggcgagaacatcatcaagcaccgcgccttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggcgatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgccaacatcaaggtgctcaagcaggagaagaaggacctgtacatccggaactacatcgcccacttcaactacatcccccacgccgagatctccctgctcgaggtcctggagaacctgcgcaagctcctgagctacgaccgcaagctgaagaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11138 - RNA, 3480 nt, synthetic construct
  misc_feature 1..3480: note = Cas13a variant__Leptotrichia buccalis__WP_015770004.1__Cas13a(N314A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcgccatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcgcgcaaccggcagaacgaggccttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgcgttcaagaacatcgccccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgcggggaaccaggacgaggaggagaaggacacctacatcgacttcatccagaagatcttcctcaagggcttcatgacctacctggccaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggcggacgagatcggcaagttcctggacttcaacgggaacaaggtgaaggacaacaaggagctcaagaagttcgacacgaacaagatctacttcgacggcgagaacatcatcaagcaccgcgccttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggcgatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgccaacatcaaggtgctcaagcaggagaagaaggacctgtacatccggaactacatcgcccacttcaactacatcccccacgccgagatctccctgctcgaggtcctggagaacctgcgcaagctcctgagctacgaccgcaagctgaagaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11139 - RNA, 3480 nt, synthetic construct
  misc_feature 1..3480: note = Cas13a variant__Leptotrichia buccalis__WP_015770004.1__Cas13a(R1072A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctggccaagctcctgagctacgaccgcaagctgaagaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccgcaactccgaggagctgtgcaagctcgtcaagatcatgttcgagtacaagatggaggagaagaagtccgagaactga

SEQ ID NO: 11140 - RNA, 3480 nt, synthetic construct
  misc_feature 1..3480: note = Cas13a variant__Leptotrichia buccalis__WP_015770004.1__Cas13a(D1078A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctgcgcaagctcctgagctacgcccgcaagctgaagaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11141 - RNA, 3480 nt, synthetic construct
  misc_feature 1..3480: note = Cas13a variant__Leptotrichia buccalis__WP_015770004.1__Cas13a(R1079A,K1080A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctgcgcaagctcctgagctacgacgccgcgctgaagaacgccgtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccgcaactccgaggagctgtgcaagctcgtcaagatcatgttcgagtacaagatggaggagaagaagtccgagaactga

SEQ ID NO: 11142 - RNA, 3480 nt, synthetic construct
  misc_feature 1..3480: note = Cas13a variant__Leptotrichia buccalis__WP_015770004.1__Cas13a(K1080A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctgcgcaagctcctgagctacgaccgcgccctgaagaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11143 - RNA, 3480 nt, synthetic construct
  misc_feature 1..3480: note = Cas13a variant__Leptotrichia buccalis__WP_015770004.1__Cas13a(K1082A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctgcgcaagctcctgagctacgaccgcaagctggccaacgcggtgatgaagtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11144 - RNA, 3480 nt, synthetic construct
  misc_feature 1..3480: note = Cas13a variant__Leptotrichia buccalis__WP_015770004.1__Cas13a(K1087A)
  source 1..3480: mol_type = other RNA
atgaaggtgaccaaggtcggcgggatcagccacaagaagtacaccagcgagggccgcctggtcaagagcgagtccgaggagaaccggacggacgagcgcctcagcgccctgctgaacatgcggctcgacatgtacatcaagaacccctccagcaccgagaccaaggagaaccagaagcgcatcgggaagctgaagaagttcttctccaacaagatggtgtacctgaaggacaacaccctcagcctgaagaacggcaagaaggagaacatcgaccgggagtactccgagacggacatcctggagagcgacgtgcgcgacaagaagaacttcgccgtgctcaagaagatctacctgaacgagaacgtgaactccgaggagctggaggtcttccggaacgacatcaagaagaagctcaacaagatcaacagcctgaagtactccttcgagaagaacaaggcgaactaccagaagatcaacgagaacaacatcgagaaggtggagggcaagagcaagcgcaacatcatctacgactactaccgggagtccgccaagcgcgacgcctacgtgagcaacgtcaaggaggccttcgacaagctgtacaaggaggaggacatcgccaagctcgtgctggagatcgagaacctgaccaagctcgagaagtacaagatccgggagttctaccacgagatcatcgggcgcaagaacgacaaggagaacttcgcgaagatcatctacgaggagatccagaacgtgaacaacatgaaggagctgatcgagaaggtcccggacatgtccgagctgaagaagtcccaggtgttctacaagtactacctcgacaaggaggagctgaacgacaagaacatcaagtacgccttctgccacttcgtggagatcgagatgagccagctgctcaagaactacgtctacaagcggctgagcaacatcagcaacgacaagatcaagcgcatcttcgagtaccagaacctgaagaagctcatcgagaacaagctgctgaacaagctcgacacctacgtgcggaactgcggcaagtacaactactacctgcaggacggggagatcgccacctccgacttcatcgcccgcaaccggcagaacgaggcgttcctgcgcaacatcatcggcgtgagctccgtcgcctacttcagcctccggaacatcctggagacggagaacgagaacgacatcaccgggcgcatgcggggcaagaccgtgaagaacaacaagggggaggagaagtacgtgtccggcgaggtcgacaagatctacaacgagaacaagaagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggaggggaaggacatcttcgccttcaagaacatcgcgccctccgagatcagcaagaagatgttccagaacgagatcaacgagaagaagctgaagctcaagatcttccgccagctgaactccgccaacgtcttccggtacctggagaagtacaagatcctcaactacctgaagcgcacccggttcgagttcgtgaacaagaacatccccttcgtccccagcttcacgaagctgtactcccgcatcgacgacctcaagaacagcctgggcatctactggaagaccccgaagaccaacgacgacaacaagaccaaggagatcatcgacgcccagatctacctgctcaagaacatctactacggggagttcctgaactacttcatgtccaacaacggcaacttcttcgagatcagcaaggagatcatcgagctgaacaagaacgacaagcggaacctgaagacgggcttctacaagctccagaagttcgaggacatccaggagaagatccccaaggagtacctggccaacatccagtccctgtacatgatcaacgccgggaaccaggacgaggaggagaaggacacctacatcgacttcatccagaagatcttcctcaagggcttcatgacctacctggcgaacaacgggcgcctgagcctcatctacatcggctccgacgaggagaccaacacgagcctggccgagaagaagcaggagttcgacaagttcctgaagaagtacgagcagaacaacaacatcaagatcccctacgagatcaacgagttcctccgggagatcaagctggggaacatcctgaagtacaccgagcgcctcaacatgttctacctgatcctgaagctcctgaaccacaaggagctgaccaacctcaagggcagcctggagaagtaccagtccgccaacaaggaggaggccttcagcgaccagctggagctcatcaacctgctgaacctcgacaacaaccgggtgaccgaggacttcgagctggaggccgacgagatcggcaagttcctggacttcaacgggaacaaggtgaaggacaacaaggagctcaagaagttcgacacgaacaagatctacttcgacggcgagaacatcatcaagcaccgcgcgttctacaacatcaagaagtacgggatgctgaacctgctcgagaagatcgccgacaaggccggctacaagatctccatcgaggagctgaagaagtacagcaacaagaagaacgagatcgagaagaaccacaagatgcaggagaacctgcaccggaagtacgcccgcccccggaaggacgagaagttcaccgacgaggactacgagtcctacaagcaggccatcgagaacatcgaggagtacacccacctcaagaacaaggtcgagttcaacgagctgaacctgctccaggggctgctgctccgcatcctgcaccggctggtgggctacaccagcatctgggagcgcgacctccggttccgcctgaagggcgagttcccggagaaccagtacatcgaggagatcttcaacttcgagaacaagaagaacgtgaagtacaagggcgggcagatcgtcgagaagtacatcaagttctacaaggagctgcaccagaacgacgaggtgaagatcaacaagtactccagcgcgaacatcaaggtgctcaagcaggagaagaaggacctgtacatccggaactacatcgcccacttcaactacatcccccacgccgagatctccctgctcgaggtcctggagaacctgcgcaagctcctgagctacgaccgcaagctgaagaacgccgtgatggcgtccgtggtcgacatcctcaaggagtacgggttcgtggccacgttcaagatcggcgccgacaagaagatcgggatccagaccctggagagcgagaagatcgtgcacctgaagaacctcaagaagaagaagctgatgaccgaccggaactccgaggagctgtgcaagctcgtcaagatcatgttcgagtacaagatggaggagaagaagtccgagaactga

SEQ ID NO: 11145 - RNA, 4170 nt, synthetic construct
  misc_feature 1..4170: note = Cas13a variant__Leptotrichia shahii__WP_018451595.1__Cas13a
  source 1..4170: mol_type = other RNA
atgggcaacctgttcgggcacaagcgctggtacgaggtgcgggacaagaaggacttcaagatcaagcgcaaggtcaaggtgaagcggaactacgacggcaacaagtacatcctcaacatcaacgagaacaacaacaaggagaagatcgacaacaacaagttcatccgcaagtacatcaactacaagaagaacgacaacatcctgaaggagttcacccggaagttccacgccgggaacatcctgttcaagctcaagggcaaggaggggatcatccgcatcgagaacaacgacgacttcctggagaccgaggaggtggtcctgtacatcgaggcctacggcaagagcgagaagctcaaggcgctgggcatcacgaagaagaagatcatcgacgaggccatccggcaggggatcaccaaggacgacaagaagatcgagatcaagcgccaggagaacgaggaggagatcgagatcgacatccgggacgagtacaccaacaagaccctgaacgactgctccatcatcctccgcatcatcgagaacgacgagctggagacgaagaagtccatctacgagatcttcaagaacatcaacatgagcctgtacaagatcatcgagaagatcatcgagaacgagaccgagaaggtgttcgagaaccggtactacgaggagcacctccgcgagaagctgctgaaggacgacaagatcgacgtgatcctcaccaacttcatggagatccgggagaagatcaagagcaacctggagatcctgggcttcgtcaagttctacctcaacgtcgggggcgacaagaagaagtccaagaacaagaagatgctggtggagaagatcctgaacatcaacgtggacctcaccgtggaggacatcgccgacttcgtgatcaaggagctggagttctggaacatcacgaagcgcatcgagaaggtcaagaaggtgaacaacgagttcctggagaagcggcgcaaccggacctacatcaagagctacgtgctcctggacaagcacgagaagttcaagatcgagcgcgagaacaagaaggacaagatcgtcaagttcttcgtggagaacatcaagaacaactccatcaaggagaagatcgagaagatcctggccgagttcaagatcgacgagctcatcaagaagctggagaaggagctgaagaaggggaactgcgacaccgagatcttcggcatcttcaagaagcactacaaggtgaacttcgacagcaagaagttctccaagaagtccgacgaggagaaggagctctacaagatcatctaccggtacctgaagggccgcatcgagaagatcctggtcaacgagcagaaggtgcggctcaagaagatggagaagatcgagatcgagaagatcctgaacgagagcatcctgagcgagaagatcctcaagcgcgtgaagcagtacaccctggagcacatcatgtacctggggaagctccgccacaacgacatcgacatgacgaccgtcaacaccgacgacttctcccggctgcacgccaaggaggagctggacctcgagctgatcaccttcttcgcgagcacgaacatggagctgaacaagatcttctcccgcgagaacatcaacaacgacgagaacatcgacttcttcggcggggaccgggagaagaactacgtgctcgacaagaagatcctgaacagcaagatcaagatcatccgcgacctggacttcatcgacaacaagaacaacatcaccaacaacttcatccggaagttcaccaagatcggcaccaacgagcgcaaccggatcctccacgccatctccaaggagcgcgacctgcagggcacgcaggacgactacaacaaggtgatcaacatcatccagaacctgaagatcagcgacgaggaggtctccaaggccctgaacctcgacgtggtcttcaaggacaagaagaacatcatcaccaagatcaacgacatcaagatcagcgaggagaacaacaacgacatcaagtacctgcccagcttctccaaggtgctgccggagatcctcaacctgtaccggaacaaccccaagaacgagcccttcgacaccatcgagaccgagaagatcgtgctgaacgccctcatctacgtcaacaaggagctgtacaagaagctgatcctcgaggacgacctggaggagaacgagagcaagaacatcttcctgcaggagctcaagaagacgctggggaacatcgacgagatcgacgagaacatcatcgagaactactacaagaacgcgcagatctccgccagcaagggcaacaacaaggccatcaagaagtaccagaagaaggtgatcgagtgctacatcgggtacctgcgcaagaactacgaggagctgttcgacttctccgacttcaagatgaacatccaggagatcaagaagcagatcaaggacatcaacgacaacaagacctacgagcggatcaccgtgaagaccagcgacaagacgatcgtcatcaacgacgacttcgagtacatcatctccatcttcgccctcctgaacagcaacgccgtgatcaacaagatccgcaaccggttcttcgcgacctccgtgtggctcaacaccagcgagtaccagaacatcatcgacatcctggacgagatcatgcagctgaacaccctccgcaacgagtgcatcacggagaactggaacctgaacctggaggagttcatccagaagatgaaggagatcgagaaggacttcgacgacttcaagatccagaccaagaaggagatcttcaacaactactacgaggacatcaagaacaacatcctcaccgagttcaaggacgacatcaacggctgcgacgtcctggagaagaagctggagaagatcgtgatcttcgacgacgagaccaagttcgagatcgacaagaagtccaacatcctccaggacgagcagcggaagctgagcaacatcaacaagaaggacctgaagaagaaggtggaccagtacatcaaggacaaggaccaggagatcaagtccaagatcctctgccgcatcatcttcaacagcgacttcctgaagaagtacaagaaggagatcgacaacctgatcgaggacatggagtccgagaacgagaacaagttccaggagatctactaccccaaggagcggaagaacgagctctacatctacaagaagaacctgttcctgaacatcgggaacccgaacttcgacaagatctacggcctcatcagcaacgacatcaagatggccgacgccaagttcctgttcaacatcgacggcaagaacatccgcaagaacaagatctccgagatcgacgccatcctgaagaacctcaacgacaagctgaacgggtacagcaaggagtacaaggagaagtacatcaagaagctgaaggagaacgacgacttcttcgccaagaacatccagaacaagaactacaagtccttcgagaaggactacaaccgggtcagcgagtacaagaagatccgcgacctcgtggagttcaactacctgaacaagatcgagagctacctgatcgacatcaactggaagctcgcgatccagatggcccgcttcgagcgggacatgcactacatcgtgaacggcctgcgcgagctggggatcatcaagctctccggctacaacacggggatcagccgggcctaccccaagcgcaacggctccgacggcttctacaccaccaccgcctactacaagttcttcgacgaggagagctacaagaagttcgagaagatctgctacgggttcggcatcgacctgtccgagaacagcgagatcaacaagcccgagaacgagtccatccggaactacatcagccacttctacatcgtccgcaaccccttcgccgactactccatcgcggagcagatcgaccgggtgagcaacctgctctcctacagcacccgctacaacaactccacgtacgccagcgtgttcgaggtcttcaagaaggacgtgaacctggactacgacgagctgaagaagaagttcaagctcatcgggaacaacgacatcctggagcggctgatgaagccgaagaaggtgtccgtcctcgagctggagagctacaactccgactacatcaagaacctgatcatcgagctcctgaccaagatcgagaacaccaacgacaccctgtga

SEQ ID NO: 11146 - RNA, 4170 nt, synthetic construct; identical to SEQ ID NO: 11145
  misc_feature 1..4170: note = Cas13a variant__Leptotrichia shahii__WP_018451595.1__Cas13a
  source 1..4170: mol_type = other RNA

SEQ ID NO: 11147 - RNA, 4305 nt, synthetic construct
  misc_feature 1..4305: note = Cas13a variant__Leptotrichia shahii__WP_018451595.1__Cas13a(long)
  source 1..4305: mol_type = other RNA
atgggcaacctgttcgggcacaagcgctggtacgaggtgcgggacaagaaggacttcaagatcaagcgcaaggtcaaggtgaagcggaactacgacggcaacaagtacatcctcaacatcaacgagaacaacaacaaggagaagatcgacaacaacaagttcatccgcaagtacatcaactacaagaagaacgacaacatcctgaaggagttcacccggaagttccacgccgggaacatcctgttcaagctcaagggcaaggaggggatcatccgcatcgagaacaacgacgacttcctggagaccgaggaggtggtcctgtacatcgaggcctacggcaagagcgagaagctcaaggcgctgggcatcacgaagaagaagatcatcgacgaggccatccggcaggggatcaccaaggacgacaagaagatcgagatcaagcgccaggagaacgaggaggagatcgagatcgacatccgggacgagtacaccaacaagaccctgaacgactgctccatcatcctccgcatcatcgagaacgacgagctggagacgaagaagtccatctacgagatcttcaagaacatcaacatgagcctgtacaagatcatcgagaagatcatcgagaacgagaccgagaaggtgttcgagaaccggtactacgaggagcacctccgcgagaagctgctgaaggacgacaagatcgacgtgatcctcaccaacttcatggagatccgggagaagatcaagagcaacctggagatcctgggcttcgtcaagttctacctcaacgtcgggggcgacaagaagaagtccaagaacaagaagatgctggtggagaagatcctgaacatcaacgtggacctcaccgtggaggacatcgccgacttcgtgatcaaggagctggagttctggaacatcacgaagcgcatcgagaaggtcaagaaggtgaacaacgagttcctggagaagcggcgcaaccggacctacatcaagagctacgtgctcctggacaagcacgagaagttcaagatcgagcgcgagaacaagaaggacaagatcgtcaagttcttcgtggagaacatcaagaacaactccatcaaggagaagatcgagaagatcctggccgagttcaagatcgacgagctcatcaagaagctggagaaggagctgaagaaggggaactgcgacaccgagatcttcggcatcttcaagaagcactacaaggtgaacttcgacagcaagaagttctccaagaagtccgacgaggagaaggagctctacaagatcatctaccggtacctgaagggccgcatcgagaagatcctggtcaacgagcagaaggtgcggctcaagaagatggagaagatcgagatcgagaagatcctgaacgagagcatcctgagcgagaagatcctcaagcgcgtgaagcagtacaccctggagcacatcatgtacctggggaagctccgccacaacgacatcgacatgacgaccgtcaacaccgacgacttctcccggctgcacgccaaggaggagctggacctcgagctgatcaccttcttcgcgagcacgaacatggagctgaacaagatcttctcccgcgagaacatcaacaacgacgagaacatcgacttcttcggcggggaccgggagaagaactacgtgctcgacaagaagatcctgaacagcaagatcaagatcatccgcgacctggacttcatcgacaacaagaacaacatcaccaacaacttcatccggaagttcaccaagatcggcaccaacgagcgcaaccggatcctccacgccatctccaaggagcgcgacctgcagggcacgcaggacgactacaacaaggtgatcaacatcatccagaacctgaagatcagcgacgaggaggtctccaaggccctgaacctcgacgtggtcttcaaggacaagaagaacatcatcaccaagatcaacgacatcaagatcagcgaggagaacaacaacgacatcaagtacctgcccagcttctccaaggtgctgccggagatcctcaacctgtaccggaacaaccccaagaacgagcccttcgacaccatcgagaccgagaagatcgtgctgaacgccctcatctacgtcaacaaggagctgtacaagaagctgatcctcgaggacgacctggaggagaacgagagcaagaacatcttcctgcaggagctcaagaagacgctggggaacatcgacgagatcgacgagaacatcatcgagaactactacaagaacgcgcagatctccgccagcaagggcaacaacaaggccatcaagaagtaccagaagaaggtgatcgagtgctacatcgggtacctgcgcaagaactacgaggagctgttcgacttctccgacttcaagatgaacatccaggagatcaagaagcagatcaaggacatcaacgacaacaagacctacgagcggatcaccgtgaagaccagcgacaagacgatcgtcatcaacgacgacttcgagtacatcatctccatcttcgccctcctgaacagcaacgccgtgatcaacaagatccgcaaccggttcttcgcgacctccgtgtggctcaacaccagcgagtaccagaacatcatcgacatcctggacgagatcatgcagctgaacaccctccgcaacgagtgcatcacggagaactggaacctgaacctggaggagttcatccagaagatgaaggagatcgagaaggacttcgacgacttcaagatccagaccaagaaggagatcttcaacaactactacgaggacatcaagaacaacatcctcaccgagttcaaggacgacatcaacggctgcgacgtcctggagaagaagctggagaagatcgtgatcttcgacgacgagaccaagttcgagatcgacaagaagtccaacatcctccaggacgagcagcggaagctgagcaacatcaacaagaaggacctgaagaagaaggtggaccagtacatcaaggacaaggaccaggagatcaagtccaagatcctctgccgcatcatcttcaacagcgacttcctgaagaagtacaagaaggagatcgacaacctgatcgaggacatggagtccgagaacgagaacaagttccaggagatctactaccccaaggagcggaagaacgagctctacatctacaagaagaacctgttcctgaacatcgggaacccgaacttcgacaagatctacggcctcatcagcaacgacatcaagatggccgacgccaagttcctgttcaacatcgacggcaagaacatccgcaagaacaagatctccgagatcgacgccatcctgaagaacctcaacgacaagctgaacgggtacagcaaggagtacaaggagaagtacatcaagaagctgaaggagaacgacgacttcttcgccaagaacatccagaacaagaactacaagtccttcgagaaggactacaaccgggtcagcgagtacaagaagatccgcgacctcgtggagttcaactacctgaacaagatcgagagctacctgatcgacatcaactggaagctcgcgatccagatggcccgcttcgagcgggacatgcactacatcgtgaacggcctgcgcgagctggggatcatcaagctctccggctacaacacggggatcagccgggcctaccccaagcgcaacggctccgacggcttctacaccaccaccgcctactacaagttcttcgacgaggagagctacaagaagttcgagaagatctgctacgggttcggcatcgacctgtccgagaacagcgagatcaacaagcccgagaacgagtccatccggaactacatcagccacttctacatcgtccgcaaccccttcgccgactactccatcgcggagcagatcgaccgggtgagcaacctgctctcctacagcacccgctacaacaactccacgtacgccagcgtgttcgaggtcttcaagaaggacgtgaacctggactacgacgagctgaagaagaagttcaagctcatcgggaacaacgacatcctggagcggctgatgaagccgaagaaggtgtccgtcctcgagctggagagctacaactccgactacatcaagaacctgatcatcgagctcctgaccaagatcgagaacaccaacgacaccctgaagcgccccgccgccacgaagaaggccggccaggcgaagaagaagaaggggagctacccctacgacgtgcccgactacgcctacccgtacgacgtgcccgactacgcctacccctacgacgtccccgactacgcctga

SEQ ID NO: 11148 - RNA, 4158 nt, synthetic construct
  misc_feature 1..4158: note = Cas13a variant__Leptotrichia sp. oral__WP_021744063.1__Cas13a
  source 1..4158: mol_type = other RNA
atgggcaacctgttcgggcacaagcgctggtacgaggtgcgggacaagaaggacttcaagatcaagcgcaaggtcaaggtgaagcggaactacgacggcaacaagtacatcctcaacatcaacgagaacaacaacaaggagaagatcgacaacaacaagttcatcggggagttcgtgaactacaagaagaacaacaacgtcctgaaggagttcaagcgcaagttccacgccggcaacatcctgttcaagctcaaggggaaggaggagatcatccggatcgagaacaacgacgacttcctggagaccgaggaggtggtgctgtacatcgaggtctacggcaagagcgagaagctcaaggccctggagatcaccaagaagaagatcatcgacgaggcgatccgccagggcatcacgaaggacgacaagaagatcgagatcaagcggcaggagaacgaggaggagatcgagatcgacatccgcgacgagtacaccaacaagaccctgaacgactgctccatcatcctccggatcatcgagaacgacgagctggagaccaagaagtccatctacgagatcttcaagaacatcaacatgagcctgtacaagatcatcgagaagatcatcgagaacgagacggagaaggtgttcgagaaccgctactacgaggagcacctccgggagaagctgctgaaggacaacaagatcgacgtgatcctcaccaacttcatggagatccgcgagaagatcaagagcaacctggagatcatggggttcgtcaagttctacctgaacgtgtccggcgacaagaagaagtccgagaacaagaagatgttcgtggagaagatcctcaacaccaacgtcgacctgaccgtggaggacatcgtggacttcatcgtcaaggagctgaagttctggaacatcacgaagcggatcgagaaggtgaagaagttcaacaacgagttcctcgagaaccgccggaaccgcacctacatcaagagctacgtgctgctggacaagcacgagaagttcaagatcgagcgggagaacaagaaggacaagatcgtcaagttcttcgtggagaacatcaagaacaacagcatcaaggagaagatcgagaagatcctcgccgagttcaagatcaacgagctgatcaagaagctggagaaggagctcaagaaggggaactgcgacaccgagatcttcggcatcttcaagaagcactacaaggtgaacttcgactccaagaagttcagcaacaagtccgacgaggagaaggagctgtacaagatcatctaccgctacctgaaggggcggatcgagaagatcctcgtcaacgagcagaaggtgcgcctgaagaagatggagaagatcgagatcgagaagatcctgaacgagagcatcctctccgagaagatcctgaagcgggtgaagcagtacaccctggagcacatcatgtacctcggcaagctgcgccacaacgacatcgtcaagatgacggtgaacaccgacgacttcagccgcctgcacgccaaggaggagctcgacctggagctgatcaccttcttcgcctccaccaacatggagctcaacaagatcttcaacggcaaggagaaggtcacggacttcttcgggttcaacctgaacggccagaagatcaccctgaaggagaaggtgcccagcttcaagctcaacatcctgaagaagctgaacttcatcaacaacgagaacaacatcgacgagaagctctcccacttctacagcttccagaaggaggggtacctgctgcggaacaagatcctgcacaactcctacggcaacatccaggagaccaagaacctcaagggcgagtacgagaacgtggagaagctgatcaaggagctgaaggtcagcgacgaggagatcagcaagtccctcagcctggacgtgatcttcgaggggaaggtggacatcatcaacaagatcaactccctgaagatcggcgagtacaaggacaagaagtacctcccgagcttctccaagatcgtcctggagatcacccgcaagttccgggagatcaacaaggacaagctgttcgacatcgagagcgagaagatcatcctcaacgccgtgaagtacgtgaacaagatcctgtacgagaagatcacgtccaacgaggagaacgagttcctgaagaccctccccgacaagctggtcaagaagtccaacaacaagaaggagaacaagaacctgctcagcatcgaggagtactacaagaacgcccaggtgagctccagcaagggggacaagaaggcgatcaagaagtaccagaacaaggtgaccaacgcctacctggagtacctggagaacaccttcacggagatcatcgacttctccaagttcaacctcaactacgacgagatcaagaccaagatcgaggagcgcaaggacaacaagagcaagatcatcatcgactccatcagcaccaacatcaacatcaccaacgacatcgagtacatcatctccatcttcgccctgctgaacagcaacacgtacatcaacaagatccggaaccgcttcttcgcgacctccgtctggctcgagaagcagaacggcaccaaggagtacgactacgagaacatcatcagcatcctggacgaggtgctgctcatcaacctgctgcgggagaacaacatcaccgacatcctcgacctgaagaacgccatcatcgacgccaagatcgtggagaacgacgagacgtacatcaagaactacatcttcgagagcaacgaggagaagctgaagaagcgcctcttctgcgaggagctggtcgacaaggaggacatccggaagatcttcgaggacgagaacttcaagttcaagtccttcatcaagaagaacgagatcgggaacttcaagatcaacttcggcatcctgagcaacctcgagtgcaactccgaggtggaggccaagaagatcatcggcaagaacagcaagaagctggagtccttcatccagaacatcatcgacgagtacaagagcaacatccgcaccctgttctccagcgagttcctcgagaagtacaaggaggagatcgacaacctggtggaggacaccgagtccgagaacaagaacaagttcgagaagatctactaccccaaggagcacaagaacgagctgtacatctacaagaagaacctcttcctgaacatcgggaaccccaacttcgacaagatctacggcctgatcagcaaggacatcaagaacgtcgacaccaagatcctcttcgacgacgacatcaagaagaacaagatctccgagatcgacgccatcctgaagaacctgaacgacaagctcaacgggtacagcaacgactacaaggcgaagtacgtgaacaagctgaaggagaacgacgacttcttcgccaagaacatccagaacgagaactactccagcttcggcgagttcgagaaggactacaacaaggtgtccgagtacaagaagatccgggacctggtcgagttcaactacctcaacaagatcgagagctacctgatcgacatcaactggaagctggccatccagatggcccgcttcgagcgggacatgcactacatcgtgaacgggctccgcgagctgggcatcatcaagctgtccggctacaacacggggatcagccgggcctacccgaagcgcaacggcagcgacgggttctacaccaccaccgcgtactacaagttcttcgacgaggagtcctacaagaagttcgagaagatctgctacggcttcgggatcgacctcagcgagaactccgagatcaacaagcccgagaacgagagcatccggaactacatctcccacttctacatcgtgcgcaaccccttcgccgactacagcatcgccgagcagatcgaccgggtctccaacctgctgagctactccacccgctacaacaacagcacgtacgcctccgtgttcgaggtgttcaagaaggacgtcaacctcgactacgacgagctgaagaagaagttccgcctgatcggcaacaacgacatcctcgagcggctgatgaagcccaagaaggtgagcgtgctggagctcgagtcctacaacagcgactacatcaagaacctgatcatcgagctgctcaccaagatcgagaacaccaacgacaccctgtga

SEQ ID NO: 11149 - RNA, 3459 nt, synthetic construct
  misc_feature 1..3459: note = Cas13a variant__Leptotrichia wadei__WP_021746774.1__Cas13a
  source 1..3459: mol_type = other RNA
atgaaggtgaccaaggtcgacggcatcagccacaagaagtacatcgaggaggggaagctggtgaagtccaccagcgaggagaaccgcacgtccgagcggctcagcgagctgctgtccatccgcctcgacatctacatcaagaaccccgacaacgccagcgaggaggagaaccggatccgccgggagaacctgaagaagttcttctccaacaaggtgctgcacctcaaggacagcgtcctgtacctgaagaaccgcaaggagaagaacgccgtgcaggacaagaactactccgaggaggacatcagcgagtacgacctcaagaacaagaactccttcagcgtgctgaagaagatcctgctcaacgaggacgtcaactccgaggagctggagatcttccggaaggacgtggaggcgaagctgaacaagatcaacagcctcaagtactccttcgaggagaacaaggccaactaccagaagatcaacgagaacaacgtggagaaggtcggcggcaagagcaagcgcaacatcatctacgactactaccgggagtccgccaagcgcaacgactacatcaacaacgtgcaggaggccttcgacaagctgtacaagaaggaggacatcgagaagctgttcttcctcatcgagaacagcaagaagcacgagaagtacaagatccgggagtactaccacaagatcatcgggcgcaagaacgacaaggagaacttcgccaagatcatctacgaggagatccagaacgtgaacaacatcaaggagctgatcgagaagatcccggacatgtccgagctgaagaagtcccaggtcttctacaagtactacctcgacaaggaggagctgaacgacaagaacatcaagtacgcgttctgccacttcgtggagatcgagatgagccagctgctcaagaactacgtgtacaagcggctgagcaacatcagcaacgacaagatcaagcgcatcttcgagtaccagaacctgaagaagctcatcgagaacaagctgctgaacaagctcgacacctacgtccggaactgcgggaagtacaactactacctccaggtgggcgagatcgccacctccgacttcatcgcccgcaaccggcagaacgaggccttcctgcgcaacatcatcggcgtgagctccgtcgcgtacttcagcctgcggaacatcctggagaccgagaacgagaacgggatcacgggccgcatgcgggggaagaccgtgaagaacaacaagggcgaggagaagtacgtgtccggggaggtcgacaagatctacaacgagaacaagcagaacgaggtgaaggagaacctgaagatgttctacagctacgacttcaacatggacaacaagaacgagatcgaggacttcttcgccaacatcgacgaggccatctccagcatccgccacggcatcgtgcacttcaacctcgagctggagggcaaggacatcttcgccttcaagaacatcgccccctccgagatcagcaagaagatgttccagaacgagatcaacgagaagaagctgaagctcaagatcttcaagcagctgaactccgcgaacgtcttcaactactacgagaaggacgtgatcatcaagtacctgaagaacaccaagttcaacttcgtcaacaagaacatccccttcgtgcccagcttcaccaagctctacaacaagatcgaggacctgcgcaacacgctgaagttcttctggtccgtgccgaaggacaaggaggagaaggacgcccagatctacctcctgaagaacatctactacggggagttcctgaacaagttcgtcaagaacagcaaggtgttcttcaagatcaccaacgaggtgatcaagatcaacaagcagcggaaccagaagaccggccactacaagtaccagaagttcgagaacatcgagaagaccgtccccgtggagtacctcgccatcatccagtcccgcgagatgatcaacaaccaggacaaggaggagaagaacacgtacatcgacttcatccagcagatcttcctgaaggggttcatcgactacctgaacaagaacaacctgaagtacatcgagagcaacaacaacaacgacaacaacgacatcttctccaagatcaagatcaagaaggacaacaaggagaagtacgacaagatcctcaagaactacgagaagcacaaccggaacaaggagatcccccacgagatcaacgagttcgtgcgcgagatcaagctgggcaagatcctgaagtacaccgagaacctcaacatgttctacctgatcctgaagctcctgaaccacaaggagctgaccaacctcaagggcagcctggagaagtaccagagcgccaacaaggaggagaccttctccgacgagctggagctcatcaacctgctgaacctcgacaacaaccgggtcacggaggacttcgagctggaggccaacgagatcgggaagttcctggacttcaacgagaacaagatcaaggaccgcaaggagctcaagaagttcgacaccaacaagatctacttcgacggcgagaacatcatcaagcaccgggcgttctacaacatcaagaagtacgggatgctgaacctgctcgagaagatcgccgacaaggccaagtacaagatcagcctgaaggagctgaaggagtactccaacaagaagaacgagatcgagaagaactacaccatgcagcagaacctccaccgcaagtacgcccggcccaagaaggacgagaagttcaacgacgaggactacaaggagtacgagaaggccatcggcaacatccagaagtacacccacctgaagaacaaggtggagttcaacgagctgaacctcctgcaggggctgctcctgaagatcctgcaccgcctcgtgggctacacgagcatctgggagcgggacctgcgcttccggctgaagggcgagttcccggagaaccactacatcgaggagatcttcaacttcgacaactccaagaacgtcaagtacaagagcgggcagatcgtggagaagtacatcaacttctacaaggagctctacaaggacaacgtggagaagcgctccatctacagcgacaagaaggtcaagaagctgaagcaggagaagaaggacctgtacatccggaactacatcgcgcacttcaactacatcccccacgccgagatctccctcctggaggtgctggagaacctccgcaagctgctgagctacgaccggaagctcaagaacgccatcatgaagtccatcgtggacatcctgaaggagtacggcttcgtcgccaccttcaagatcggggccgacaagaagatcgagatccagaccctggagagcgagaagatcgtgcacctcaagaacctgaagaagaagaagctgatgaccgaccgcaactccgaggagctctgcgagctggtgaaggtcatgttcgagtacaaggcgctggagtga

SEQ ID NO: 11150 - RNA, 3459 nt, synthetic construct
  misc_feature 1..3459: note = Cas13a variant__Leptotrichia wadei__WP_021746774.1__Cas13a(G403D)
  source 1..3459: mol_type = other RNA
atgaaggtgaccaaggtcgacggcatcagccacaagaagtacatcgaggaggggaagctggtgaagtccaccagcgaggagaaccgcacgtccgagcggctcagcgagctgctgtccatccgcctcgacatctacatcaagaaccccgacaacgccagcgaggaggagaaccggatccgccgggagaacctgaagaagttcttctccaacaaggtgctgcacctcaaggacagcgtcctgtacctgaagaaccgcaaggagaagaacgccgtgcaggacaagaactactccgaggaggacatcagcgagtacgacctcaagaacaagaactccttcagcgtgctgaagaagatcctgctcaacgaggacgtcaactccgaggagctggagatcttccggaaggacgtggaggcgaagctgaacaagatcaacagcctcaagtactccttcgaggagaacaaggccaactaccagaagatcaacgagaacaacgtggagaaggtcggcggcaagagcaagcgcaacatcatctacgactactaccgggagtccgccaagcgcaacgactacatcaacaacgtgcaggaggccttcgacaagctgtacaagaaggaggacatcgagaagctgttcttcctcatcgagaacagcaagaagcacgagaagtacaagatccgggagtactaccacaagatcatcgggcgcaagaacgacaaggagaacttcgccaagatcatctacgaggagatccagaacgtgaacaacatcaaggagctgatcgagaagatcccggacatgtccgagctgaagaagtcccaggtcttctacaagtactacctcgacaaggaggagctgaacgacaagaacatcaagtacgcgttctgccacttcgtggagatcgagatgagccagctgctcaagaactacgtgtacaagcggctgagcaacatcagcaacgacaagatcaagcgcatcttcgagtaccagaacctgaagaagctcatcgagaacaagctgctgaacaagctcgacacctacgtccggaactgcgggaagtacaactactacctccaggtgggcgagatcgccacctccgacttcatcgcccgcaaccggcagaacgaggccttcctgcgcaacatcatcggcgtgagctccgtcgcgtacttcagcctgcggaacatcctggagaccgagaacgagaacgacatcacggggcgcatgcggggcaagaccgtgaagaacaacaagggggaggagaagtacgtgtccggcgaggtcgacaagatctacaacgagaacaagcagaacgaggtgaaggagaacctgaagatgttctacagctacgacttcaacatggacaacaagaacgagatcgaggacttcttcgccaacatcgacgaggccatctccagcatccgccacgggatcgtgcacttcaacctcgagctggagggcaaggacatcttcgccttcaagaacatcgccccctccgagatcagcaagaagatgttccagaacgagatcaacgagaagaagctgaagctcaagatcttcaagcagctgaactccgcgaacgtcttcaactactacgagaaggacgtgatcatcaagtacctgaagaacaccaagttcaacttcgtcaacaagaacatccccttcgtgcccagcttcaccaagctctacaacaagatcgaggacctgcgcaacacgctgaagttcttctggtccgtgccgaaggacaaggaggagaaggacgcccagatctacctcctgaagaacatctactacggcgagttcctgaacaagttcgtcaagaacagcaaggtgttcttcaagatcaccaacgaggtgatcaagatcaacaagcagcggaaccagaagaccgggcactacaagtaccagaagttcgagaacatcgagaagaccgtccccgtggagtacctcgccatcatccagtcccgcgagatgatcaacaaccaggacaaggaggagaagaacacgtacatcgacttcatccagcagatcttcctgaagggcttcatcgactacctgaacaagaacaacctgaagtacatcgagagcaacaacaacaacgacaacaacgacatcttctccaagatcaagatcaagaaggacaacaaggagaagtacgacaagatcctcaagaactacgagaagcacaaccggaacaaggagatcccccacgagatcaacgagttcgtgcgcgagatcaagctggggaagatcctgaagtacaccgagaacctcaacatgttctacctgatcctgaagctcctgaaccacaaggagctgaccaacctcaagggcagcctggagaagtaccagagcgccaacaaggaggagaccttctccgacgagctggagctcatcaacctgctgaacctcgacaacaaccgggtcacggaggacttcgagctggaggccaacgagatcggcaagttcctggacttcaacgagaacaagatcaaggaccgcaaggagctcaagaagttcgacaccaacaagatctacttcgacggggagaacatcatcaagcaccgggcgttctacaacatcaagaagtacggcatgctgaacctgctcgagaagatcgccgacaaggccaagtacaagatcagcctgaaggagctgaaggagtactccaacaagaagaacgagatcgagaagaactacaccatgcagcagaacctccaccgcaagtacgcccggcccaagaaggacgagaagttcaacgacgaggactacaaggagtacgagaaggccatcgggaacatccagaagtacacccacctgaagaacaaggtggagttcaacgagctgaacctcctgcagggcctgctcctgaagatcctgcaccgcctcgtggggtacacgagcatctgggagcgggacctgcgcttccggctgaagggcgagttcccggagaaccactacatcgaggagatcttcaacttcgacaactccaagaacgtcaagtacaagagcggccagatcgtggagaagtacatcaacttctacaaggagctctacaaggacaacgtggagaagcgctccatctacagcgacaagaaggtcaagaagctgaagcaggagaagaaggacctgtacatccggaactacatcgcgcacttcaactacatcccccacgccgagatctccctcctggaggtgctggagaacctccgcaagctgctgagctacgaccggaagctcaagaacgccatcatgaagtccatcgtggacatcctgaaggagtacgggttcgtcgccaccttcaagatcggcgccgacaagaagatcgagatccagaccctggagagcgagaagatcgtgcacctcaagaacctgaagaagaagaagctgatgaccgaccgcaactccgaggagctctgcgagctggtgaaggtcatgttcgagtacaaggcgctggagtga

SEQ ID NO: 11151 - RNA, 3909 nt, synthetic construct
  misc_feature 1..3909: note = Cas13a variant__Leptotrichia wadei__WP_021746774.1__6xHis-Tag/Twin-Strep/SUMO_Cas13a(G40 3D)
  source 1..3909: mol_type = other RNA
atgggcagctcccaccaccaccaccaccacagctccgggctggtgccccgcggcagccacatggcctcctggagccacccgcagttcgagaagggcggcgggtccgggggcgggagcggcgggtccgcctggagccacccccagttcgagaagatgtccgacagcgaggtcaaccaggaggcgaagcccgaggtgaagcccgaggtgaagccggagacccacatcaacctcaaggtctccgacggcagctccgagatcttcttcaagatcaagaagaccacgcccctgcggcgcctgatggaggccttcgccaagcggcaggggaaggagatggacagcctccgcttcctgtacgacggcatccggatccaggccgaccagacccccgaggacctggacatggaggacaacgacatcatcgaggcccaccgcgagcagatcggcgggtccatgaaggtgaccaaggtggacggcatcagccacaagaagtacatcgaggaggggaagctcgtcaagtccaccagcgaggagaaccggacgagcgagcgcctgtccgagctgctcagcatccggctggacatctacatcaagaaccccgacaacgcgtccgaggaggagaaccgcatccggcgcgagaacctgaagaagttcttcagcaacaaggtgctccacctgaaggactccgtgctgtacctcaagaaccggaaggagaagaacgccgtccaggacaagaactacagcgaggaggacatctccgagtacgacctgaagaacaagaacagcttctccgtgctgaagaagatcctcctgaacgaggacgtgaacagcgaggagctggagatcttccgcaaggacgtcgaggccaagctcaacaagatcaactccctgaagtacagcttcgaggagaacaaggccaactaccagaagatcaacgagaacaacgtggagaaggtgggcggcaagtccaagcggaacatcatctacgactactaccgcgagagcgcgaagcggaacgactacatcaacaacgtccaggaggccttcgacaagctgtacaagaaggaggacatcgagaagctgttcttcctcatcgagaactccaagaagcacgagaagtacaagatccgcgagtactaccacaagatcatcgggcggaagaacgacaaggagaacttcgccaagatcatctacgaggagatccagaacgtgaacaacatcaaggagctgatcgagaagatcccggacatgagcgagctcaagaagtcccaggtgttctacaagtactacctggacaaggaggagctgaacgacaagaacatcaagtacgccttctgccacttcgtcgagatcgagatgagccagctcctgaagaactacgtgtacaagcgcctgtccaacatcagcaacgacaagatcaagcggatcttcgagtaccagaacctcaagaagctgatcgagaacaagctgctcaacaagctggacacctacgtgcgcaactgcggcaagtacaactactacctgcaggtcggggagatcgccaccagcgacttcatcgcgcgcaaccggcagaacgaggccttcctccgcaacatcatcggcgtgtccagcgtggcctacttctccctgcggaacatcctggagaccgagaacgagaacgacatcacggggcgcatgcggggcaagaccgtcaagaacaacaagggcgaggagaagtacgtgagcggggaggtcgacaagatctacaacgagaacaagcagaacgaggtgaaggagaacctcaagatgttctactcctacgacttcaacatggacaacaagaacgagatcgaggacttcttcgccaacatcgacgaggccatcagctccatccgccacggcatcgtgcacttcaacctggagctggaggggaaggacatcttcgcgttcaagaacatcgcccccagcgagatctccaagaagatgttccagaacgagatcaacgagaagaagctcaagctgaagatcttcaagcagctgaacagcgccaacgtcttcaactactacgagaaggacgtgatcatcaagtacctcaagaacaccaagttcaacttcgtgaacaagaacatccccttcgtcccctccttcaccaagctgtacaacaagatcgaggacctgcggaacacgctgaagttcttctggagcgtgccgaaggacaaggaggagaaggacgcccagatctacctcctgaagaacatctactacggcgagttcctgaacaagttcgtgaagaactccaaggtcttcttcaagatcaccaacgaggtgatcaagatcaacaagcagcgcaaccagaagaccgggcactacaagtaccagaagttcgagaacatcgagaagaccgtgcccgtcgagtacctcgccatcatccagagccgggagatgatcaacaaccaggacaaggaggagaagaacacgtacatcgacttcatccagcagatcttcctgaagggcttcatcgactacctgaacaagaacaacctcaagtacatcgagtccaacaacaacaacgacaacaacgacatcttcagcaagatcaagatcaagaaggacaacaaggagaagtacgacaagatcctgaagaactacgagaagcacaaccgcaacaaggagatcccccacgagatcaacgagttcgtgcgggagatcaagctgggcaagatcctcaagtacaccgagaacctgaacatgttctacctgatcctcaagctgctgaaccacaaggagctcaccaacctgaaggggtccctggagaagtaccagagcgcgaacaaggaggagaccttcagcgacgagctcgagctgatcaacctgctcaacctggacaacaaccgcgtgacggaggacttcgagctggaggccaacgagatcggcaagttcctcgacttcaacgagaacaagatcaaggaccggaaggagctgaagaagttcgacaccaacaagatctacttcgacggggagaacatcatcaagcaccgcgccttctacaacatcaagaagtacggcatgctgaacctcctggagaagatcgccgacaaggccaagtacaagatctccctgaaggagctcaaggagtacagcaacaagaagaacgagatcgagaagaactacaccatgcagcagaacctgcaccggaagtacgcgcgccccaagaaggacgagaagttcaacgacgaggactacaaggagtacgagaaggccatcgggaacatccagaagtacacccacctgaagaacaaggtcgagttcaacgagctcaacctgctgcagggcctcctgctgaagatcctccaccggctggtgggctacacgtccatctgggagcgcgacctgcggttccgcctcaagggggagttcccggagaaccactacatcgaggagatcttcaacttcgacaacagcaagaacgtgaagtacaagtccggccagatcgtcgagaagtacatcaacttctacaaggagctgtacaaggacaacgtggagaagcgcagcatctactccgacaagaaggtgaagaagctgaagcaggagaagaaggacctctacatccggaactacatcgcccacttcaactacatcccccacgccgagatcagcctgctggaggtcctcgagaacctgcgcaagctgctctcctacgaccggaagctgaagaacgcgatcatgaagtccatcgtggacatcctgaaggagtacgggttcgtggccaccttcaagatcggcgccgacaagaagatcgagatccagaccctcgagagcgagaagatcgtccacctgaagaacctgaagaagaagaagctcatgaccgaccgcaacagcgaggagctgtgcgagctggtgaaggtgatgttcgagtacaaggccctcgagtga

SEQ ID NO: 11152 - RNA, 3459 nt, synthetic construct
  misc_feature 1..3459: note = Cas13a variant__Leptotrichia wadei__WP_021746774.1__Cas13a(R474A,R1046A)
  source 1..3459: mol_type = other RNA
atgaaggtgaccaaggtcgacggcatcagccacaagaagtacatcgaggaggggaagctggtgaagtccaccagcgaggagaaccgcacgtccgagcggctcagcgagctgctgtccatccgcctcgacatctacatcaagaaccccgacaacgccagcgaggaggagaaccggatccgccgggagaacctgaagaagttcttctccaacaaggtgctgcacctcaaggacagcgtcctgtacctgaagaaccgcaaggagaagaacgccgtgcaggacaagaactactccgaggaggacatcagcgagtacgacctcaagaacaagaactccttcagcgtgctgaagaagatcctgctcaacgaggacgtcaactccgaggagctggagatcttccggaaggacgtggaggcgaagctgaacaagatcaacagcctcaagtactccttcgaggagaacaaggccaactaccagaagatcaacgagaacaacgtggagaaggtcggcggcaagagcaagcgcaacatcatctacgactactaccgggagtccgccaagcgcaacgactacatcaacaacgtgcaggaggccttcgacaagctgtacaagaaggaggacatcgagaagctgttcttcctcatcgagaacagcaagaagcacgagaagtacaagatccgggagtactaccacaagatcatcgggcgcaagaacgacaaggagaacttcgccaagatcatctacgaggagatccagaacgtgaacaacatcaaggagctgatcgagaagatcccggacatgtccgagctgaagaagtcccaggtcttctacaagtactacctcgacaaggaggagctgaacgacaagaacatcaagtacgcgttctgccacttcgtggagatcgagatgagccagctgctcaagaactacgtgtacaagcggctgagcaacatcagcaacgacaagatcaagcgcatcttcgagtaccagaacctgaagaagctcatcgagaacaagctgctgaacaagctcgacacctacgtccggaactgcgggaagtacaactactacctccaggtgggcgagatcgccacctccgacttcatcgcccgcaaccggcagaacgaggccttcctgcgcaacatcatcggcgtgagctccgtcgcgtacttcagcctgcggaacatcctggagaccgagaacgagaacgggatcacgggccgcatgcgggggaagaccgtgaagaacaacaagggcgaggagaagtacgtgtccggggaggtcgacaagatctacaacgagaacaagcagaacgaggtgaaggagaacctgaagatgttctacagctacgacttcaacatggacaacaagaacgagatcgaggacttcttcgccaacatcgacgaggccatctccagcatcgcccacggcatcgtgcacttcaacctcgagctggagggcaaggacatcttcgccttcaagaacatcgcgccctccgagatcagcaagaagatgttccagaacgagatcaacgagaagaagctgaagctcaagatcttcaagcagctgaactccgccaacgtcttcaactactacgagaaggacgtgatcatcaagtacctgaagaacaccaagttcaacttcgtcaacaagaacatccccttcgtgcccagcttcaccaagctctacaacaagatcgaggacctgcgcaacacgctgaagttcttctggtccgtgccgaaggacaaggaggagaaggacgcccagatctacctcctgaagaacatctactacggggagttcctgaacaagttcgtcaagaacagcaaggtgttcttcaagatcaccaacgaggtgatcaagatcaacaagcagcgcaaccagaagaccggccactacaagtaccagaagttcgagaacatcgagaagaccgtccccgtggagtacctcgccatcatccagtcccgggagatgatcaacaaccaggacaaggaggagaagaacacgtacatcgacttcatccagcagatcttcctgaaggggttcatcgactacctgaacaagaacaacctgaagtacatcgagagcaacaacaacaacgacaacaacgacatcttctccaagatcaagatcaagaaggacaacaaggagaagtacgacaagatcctcaagaactacgagaagcacaaccgcaacaaggagatcccccacgagatcaacgagttcgtgcgggagatcaagctgggcaagatcctgaagtacaccgagaacctcaacatgttctacctgatcctgaagctcctgaaccacaaggagctgaccaacctcaagggcagcctggagaagtaccagagcgccaacaaggaggagaccttctccgacgagctggagctcatcaacctgctgaacctcgacaacaaccgcgtcacggaggacttcgagctggaggcgaacgagatcgggaagttcctggacttcaacgagaacaagatcaaggaccggaaggagctcaagaagttcgacaccaacaagatctacttcgacggcgagaacatcatcaagcaccgcgccttctacaacatcaagaagtacgggatgctgaacctgctcgagaagatcgccgacaaggccaagtacaagatcagcctgaaggagctgaaggagtactccaacaagaagaacgagatcgagaagaactacaccatgcagcagaacctccaccggaagtacgcccgccccaagaaggacgagaagttcaacgacgaggactacaaggagtacgagaaggcgatcggcaacatccagaagtacacccacctgaagaacaaggtggagttcaacgagctgaacctcctgcaggggctgctcctgaagatcctgcaccggctcgtgggctacacgagcatctgggagcgcgacctgcggttccgcctgaagggcgagttcccggagaaccactacatcgaggagatcttcaacttcgacaactccaagaacgtcaagtacaagagcgggcagatcgtggagaagtacatcaacttctacaaggagctctacaaggacaacgtggagaagcggtccatctacagcgacaagaaggtcaagaagctgaagcaggagaagaaggacctgtacatcgccaactacatcgcccacttcaactacatcccccacgccgagatctccctcctggaggtgctggagaacctccgcaagctgctgagctacgaccggaagctcaagaacgccatcatgaagtccatcgtggacatcctgaaggagtacggcttcgtcgcgaccttcaagatcggggccgacaagaagatcgagatccagaccctggagagcgagaagatcgtgcacctcaagaacctgaagaagaagaagctgatgaccgaccgcaactccgaggagctctgcgagctggtgaaggtcatgttcgagtacaaggccctggagtga

SEQ ID NO: 11153 - RNA, 5073 nt, synthetic construct
  misc_feature 1..5073: note = Cas13a variant__Leptotrichia wadei__WP_021746774.1__XY_Cas13a(R474A,R1046A)_EGFP_ZF-CCR5 T_KRAB -A _NLS
  source 1..5073: mol_type = other RNA
atgggcggggagggcctgcgcgccagcccccggcgccggccgctcctgcccctgcagccccgcgggtgcccccggggcgacgggtgcctccgcggcggccgggggcgcgccggcttcgggttctggcgggtgaccggcgggtcccgcgcgagcgccaaccacgtccacgccttcttcttcttcctgcagctgctcggcaacgtgctggtgatcgtcctgtcccaccacttcggcaaggagttcgggaccgccggcccgggggccacgatgaaggtgaccaaggtggacggcatcagccacaagaagtacatcgaggagggcaagctcgtcaagtccaccagcgaggagaaccggacctccgagcgcctgagcgagctgctctccatccggctggacatctacatcaagaaccccgacaacgcgagcgaggaggagaaccgcatccggcgcgagaacctgaagaagttcttctccaacaaggtgctccacctgaaggacagcgtgctgtacctcaagaaccggaaggagaagaacgccgtccaggacaagaactactccgaggaggacatcagcgagtacgacctgaagaacaagaactccttcagcgtgctgaagaagatcctcctgaacgaggacgtgaactccgaggagctggagatcttccgcaaggacgtcgaggccaagctcaacaagatcaacagcctgaagtactccttcgaggagaacaaggccaactaccagaagatcaacgagaacaacgtggagaaggtcgggggcaagagcaagcggaacatcatctacgactactaccgcgagagcgcgaagcggaacgactacatcaacaacgtgcaggaggccttcgacaagctgtacaagaaggaggacatcgagaagctgttcttcctgatcgagaactccaagaagcacgagaagtacaagatccgcgagtactaccacaagatcatcgggcgcaagaacgacaaggagaacttcgccaagatcatctacgaggagatccagaacgtgaacaacatcaaggagctgatcgagaagatccccgacatgagcgagctcaagaagtcccaggtgttctacaagtactacctggacaaggaggagctgaacgacaagaacatcaagtacgccttctgccacttcgtcgagatcgagatgagccagctcctgaagaactacgtgtacaagcggctgtccaacatcagcaacgacaagatcaagcgcatcttcgagtaccagaacctcaagaagctgatcgagaacaagctgctcaacaagctggacacgtacgtgcggaactgcggcaagtacaactactacctgcaggtcggggagatcgccacctccgacttcatcgcgcgcaaccggcagaacgaggccttcctccgcaacatcatcggcgtgagctccgtggcctacttcagcctgcggaacatcctggagaccgagaacgagaacggcatcaccgggcgcatgcggggcaagacggtcaagaacaacaagggggaggagaagtacgtgtccggcgaggtcgacaagatctacaacgagaacaagcagaacgaggtgaaggagaacctcaagatgttctacagctacgacttcaacatggacaacaagaacgagatcgaggacttcttcgccaacatcgacgaggccatctccagcatcgcgcacgggatcgtgcacttcaacctggagctggagggcaaggacatcttcgccttcaagaacatcgccccctccgagatcagcaagaagatgttccagaacgagatcaacgagaagaagctcaagctgaagatcttcaagcagctgaactccgccaacgtcttcaactactacgagaaggacgtgatcatcaagtacctgaagaacaccaagttcaacttcgtgaacaagaacatcccgttcgtccccagcttcaccaagctctacaacaagatcgaggacctgcgcaacaccctgaagttcttctggtccgtgcccaaggacaaggaggagaaggacgcccagatctacctcctgaagaacatctactacggcgagttcctgaacaagttcgtgaagaacagcaaggtcttcttcaagatcacgaacgaggtgatcaagatcaacaagcagcggaaccagaagaccgggcactacaagtaccagaagttcgagaacatcgagaagaccgtgcccgtcgagtacctcgcgatcatccagagccgcgagatgatcaacaaccaggacaaggaggagaagaacacctacatcgacttcatccagcagatcttcctgaagggcttcatcgactacctgaacaagaacaacctcaagtacatcgagtccaacaacaacaacgacaacaacgacatcttcagcaagatcaagatcaagaaggacaacaaggagaagtacgacaagatcctgaagaactacgagaagcacaaccggaacaaggagatcccgcacgagatcaacgagttcgtgcgcgagatcaagctggggaagatcctcaagtacacggagaacctgaacatgttctacctgatcctcaagctgctgaaccacaaggagctcaccaacctgaagggctccctggagaagtaccagagcgccaacaaggaggagaccttctccgacgagctcgagctgatcaacctgctcaacctggacaacaaccgggtgaccgaggacttcgagctggaggccaacgagatcgggaagttcctcgacttcaacgagaacaagatcaaggaccgcaaggagctgaagaagttcgacacgaacaagatctacttcgacggcgagaacatcatcaagcaccgggccttctacaacatcaagaagtacggcatgctgaacctcctggagaagatcgccgacaaggcgaagtacaagatcagcctgaaggagctcaaggagtactccaacaagaagaacgagatcgagaagaactacaccatgcagcagaacctgcaccgcaagtacgcccggcccaagaaggacgagaagttcaacgacgaggactacaaggagtacgagaaggccatcgggaacatccagaagtacacccacctgaagaacaaggtcgagttcaacgagctcaacctgctgcagggcctcctgctgaagatcctccaccgcctggtggggtacaccagcatctgggagcgcgacctgcggttccgcctcaagggcgagttccccgagaaccactacatcgaggagatcttcaacttcgacaactccaagaacgtgaagtacaagagcggccagatcgtcgagaagtacatcaacttctacaaggagctgtacaaggacaacgtggagaagcggtccatctacagcgacaagaaggtgaagaagctgaagcaggagaagaaggacctctacatcgccaactacatcgcgcacttcaactacatcccccacgccgagatctccctgctggaggtcctcgagaacctgcgcaagctgctcagctacgaccggaagctgaagaacgccatcatgaagtccatcgtggacatcctgaaggagtacgggttcgtggccacgttcaagatcggcgccgacaagaagatcgagatccagaccctcgagagcgagaagatcgtccacctgaagaacctgaagaagaagaagctcatgaccgaccgcaactccgaggagctgtgcgagctggtgaaggtgatgttcgagtacaaggcgctcgagggcgggggcgggagcggcgggggcgggagcggcgggggcggctccgtcagcaagggggaggagctgttcaccggcgtggtgccgatcctggtcgagctcgacggggacgtgaacggccacaagttctccgtgagcggggagggcgagggcgacgccacgtacgggaagctgaccctgaagttcatctgcaccaccggcaagctccccgtcccctggcccacgctggtgaccaccctgacctacggggtgcagtgcttctcccggtacccggaccacatgaagcagcacgacttcttcaagagcgccatgcccgagggctacgtccaggagcgcacgatcttcttcaaggacgacgggaactacaagacccgggccgaggtgaagttcgagggcgacaccctcgtgaaccgcatcgagctgaagggcatcgacttcaaggaggacgggaacatcctgggccacaagctcgagtacaactacaactcccacaacgtctacatcatggccgacaagcagaagaacgggatcaaggtgaacttcaagatccggcacaacatcgaggacggcagcgtgcagctggcggaccactaccagcagaacacccccatcggcgacgggcccgtcctgctcccggacaaccactacctgtccacccagagcgccctgtccaaggaccccaacgagaagcgcgaccacatggtgctcctggagttcgtgacggccgccggcatcaccctggggatggacgagctctacagccggggcgccggggcgggcgccggcgccggggccggctcccgcttccagtgccggatctgcatgcgcaacttcagcgaccggtccaacctgagccgccacatccggacccacaccggggagaagcccttcgcgtgcgacatctgcggccgcaagttcgccatctccagcaacctgaactcccacacgaagatccacaccgggagccagaagcccttccagtgccggatctgcatgcgcaacttcagccgctccgacaacctcgcccggcacatccgcacccacaccggcgagaagccgttcgcctgcgacatctgcggccggaagttcgccacgagcgggaacctgacccgccacaccaagatccacctccggggctcccagctcagcatcgtcgacgcgcccgagcagcgcgagggggcctcccaggtgagcgtgtccgtcaccttcgaggacgtggccgtgctgttcacgcgggacgagtggaagaagctggacctcagccagcgctccctgtaccgggaggtcatgctggagaactacagcaacctggcctccatggccggcagccccaagaagaagcgcaaggtgtga

SEQ ID NO: 11154 - RNA, 3549 nt, synthetic construct
  misc_feature 1..3549: note = Cas13a variant__Leptotrichia wadei__ERK53440.1__Cas13a
  source 1..3549: mol_type = other RNA
atgtacatgaagatcaccaagatcgacggcgtgagccactacaagaagcaggacaaggggatcctgaagaagaagtggaaggacctcgacgagcgcaagcagcgggagaagatcgaggcccgctacaacaagcagatcgagtccaagatctacaaggagttcttccggctgaagaacaagaagcgcatcgagaaggaggaggaccagaacatcaagagcctgtacttcttcatcaaggagctctacctgaacgagaagaacgaggagtgggagctgaagaacatcaacctcgagatcctggacgacaaggagcgggtcatcaagggctacaagttcaaggaggacgtgtacttcttcaaggaggggtacaaggagtactacctgcgcatcctcttcaacaacctgatcgagaaggtgcagaacgagaaccgggagaaggtccgcaagaacaaggagttcctggacctcaaggagatcttcaagaagtacaagaaccggaagatcgacctgctgctcaagtccatcaacaacaacaagatcaacctggagtacaagaaggagaacgtgaacgaggagatctacggcatcaaccccaccaacgaccgcgagatgacgttctacgagctgctcaaggagatcatcgagaagaaggacgagcagaagtccatcctggaggagaagctggacaacttcgacatcaccaacttcctcgagaacatcgagaagatcttcaacgaggagaccgagatcaacatcatcaaggggaaggtgctgaacgagctgcgggagtacatcaaggagaaggaggagaacaacagcgacaacaagctcaagcagatctacaacctggagctgaagaagtacatcgagaacaacttcagctacaagaagcagaagtccaagagcaagaacggcaagaacgactacctctacctgaacttcctgaagaagatcatgttcatcgaggaggtcgacgagaagaaggagatcaacaaggagaagttcaagaacaagatcaactccaacttcaagaacctcttcgtgcagcacatcctggactacggcaagctgctctactacaaggagaacgacgagtacatcaagaacaccgggcagctggagacgaaggacctggagtacatcaagaccaaggagaccctcatccgcaagatggccgtgctggtcagcttcgcggccaactcctactacaacctgttcggccgggtgagcggggacatcctcggcaccgaggtggtcaagtccagcaagacgaacgtgatcaaggtggggtcccacatcttcaaggagaagatgctgaactacttcttcgacttcgagatcttcgacgccaacaagatcgtcgagatcctggagagcatctcctacagcatctacaacgtgcgcaacggcgtgggccacttcaacaagctcatcctggggaagtacaagaagaaggacatcaacaccaacaagcggatcgaggaggacctgaacaacaacgaggagatcaagggctacttcatcaagaagcgcggggagatcgagcggaaggtcaaggagaagttcctctccaacaacctgcagtactactacagcaaggagaagatcgagaactacttcgaggtgtacgagttcgagatcctgaagcgcaagatcccgttcgcccccaacttcaagcggatcatcaagaagggcgaggacctcttcaacaacaagaacaacaagaagtacgagtacttcaagaacttcgacaagaacagcgccgaggagaagaaggagttcctgaagacccgcaacttcctgctgaaggagctctactacaacaacttctacaaggagttcctgtccaagaaggaggagttcgagaagatcgtgctggaggtcaaggaggagaagaagtcccggggcaacatcaacaacaagaagtccggggtgagcttccagagcatcgacgactacgacaccaagatcaacatcagcgactacatcgcgtccatccacaagaaggagatggagcgcgtggagaagtacaacgaggagaagcagaaggacacggccaagtacatccgcgacttcgtcgaggagatcttcctcaccggcttcatcaactacctggagaaggacaagcggctgcacttcctcaaggaggagttcagcatcctgtgcaacaacaacaacaacgtggtcgacttcaacatcaacatcaacgaggagaagatcaaggagttcctgaaggagaacgactccaagaccctcaacctgtacctgttcttcaacatgatcgacagcaagcgcatctccgagttccggaacgagctcgtgaagtacaagcagttcaccaagaagcgcctggacgaggagaaggagttcctggggatcaagatcgagctctacgagacgctgatcgagttcgtgatcctgacccgggagaagctcgacaccaagaagtccgaggagatcgacgcctggctggtcgacaagctgtacgtgaaggacagcaacgagtacaaggagtacgaggagatcctcaagctgttcgtggacgagaagatcctgagctccaaggaggccccctactacgcgaccgacaacaagacgcccatcctcctgagcaacttcgagaagacccgcaagtacggcacccagtccttcctgagcgagatccagtccaactacaagtacagcaaggtcgagaaggagaacatcgaggactacaacaagaaggaggagatcgagcagaagaagaagtccaacatcgagaagctccaggacctgaaggtggagctgcacaagaagtgggagcagaacaagatcaccgagaaggagatcgagaagtacaacaacacgacccggaagatcaacgagtacaactacctcaagaacaaggaggagctgcagaacgtgtacctgctccacgagatgctgagcgacctgctcgcccgcaacgtcgccttcttcaacaagtgggagcgggacttcaagttcatcgtgatcgccatcaagcagttcctgcgcgagaacgacaaggagaaggtgaacgagttcctgaacccgcccgacaacagcaaggggaagaaggtctacttctccgtgagcaagtacaagaacaccgtggagaacatcgacggcatccacaagaacttcatgaacctcatcttcctgaacaacaagttcatgaaccggaagatcgacaagatgaactgcgccatctgggtctacttccgcaactacatcgcgcacttcctgcacctccacaccaagaacgagaagatctccctgatcagccagatgaacctgctcatcaagctgttctcctacgacaagaaggtgcagaaccacatcctcaagagcacgaagaccctgctggagaagtacaacatccagatcaacttcgagatctccaacgacaagaacgaggtgttcaagtacaagatcaagaaccggctgtacagcaagaagggcaagatgctcgggaagaacaacaagttcgagatcctggagaacgagttcctggagaacgtcaaggccatgctcgagtactccgagtga

SEQ ID NO: 11155 - RNA, 4158 nt, synthetic construct
  misc_feature 1..4158: note = Cas13a variant__Clostridium aminophilum__WP_031473346.1__Cas13a
  source 1..4158: mol_type = other RNA
atgaagttcagcaaggtggaccacacccgctccgccgtcggcatccagaaggccaccgacagcgtgcacgggatgctgtacacggaccccaagaagcaggaggtgaacgacctcgacaagcggttcgaccagctgaacgtcaaggcgaagcgcctgtacaacgtgttcaaccagtccaaggccgaggaggacgacgacgagaagcggttcggcaaggtggtcaagaagctcaaccgcgagctgaaggacctcctgttccaccgggaggtgagccgctacaactccatcgggaacgccaagtacaactactacggcatcaagagcaacccggaggagatcgtgtccaacctggggatggtcgagagcctgaagggcgagcgggacccccagaaggtgatctccaagctcctgctgtactacctccgcaagggcctgaagcccgggaccgacggcctgcggatgatcctcgaggccagctgcgggctgcgcaagctgtccggcgacgagaaggagctcaaggtgttcctgcagaccctggacgaggacttcgagaagaagaccttcaagaagaacctcatccggagcatcgagaaccagaacatggccgtccagccctccaacgagggggacccgatcatcggcatcacgcagggccgcttcaacagccagaagaacgaggagaagtccgcgatcgagcggatgatgagcatgtacgccgacctgaacgaggaccaccgcgaggacgtgctgcggaagctccgccggctgaacgtgctgtacttcaacgtcgacaccgagaagaccgaggagcccaccctccccggggaggtggacacgaaccccgtgttcgaggtctggcacgaccacgagaagggcaaggagaacgaccgccagttcgccaccttcgccaagatcctgaccgaggaccgggagacccgcaagaaggagaagctggcggtgaaggaggccctcaacgacctgaagtccgccatccgggaccacaacatcatggcctaccgctgcagcatcaaggtgacggagcaggacaaggacgggctgttcttcgaggaccagcgcatcaaccggttctggatccaccacatcgagtccgccgtcgagcgcatcctcgcgagcatcaacccggagaagctgtacaagctgcggatcggctacctcggcgagaaggtgtggaaggacctgctgaactacctcagcatcaagtacatcgccgtggggaaggccgtcttccacttcgccatggaggacctgggcaagaccgggcaggacatcgagctgggcaagctctccaacagcgtgtccgggggcctgaccagcttcgactacgagcagatccgcgccgacgagaccctgcagcggcagctctccgtcgaggtggcgttcgccgccaacaacctgttccgcgccgtggtcggccagacggggaagaagatcgagcagagcaagtccgaggagaacgaggaggacttcctgctctggaaggccgagaagatcgcggagagcatcaagaaggagggcgaggggaacaccctgaagtccatcctgcagttcttcggcggggccagctcctgggacctgaaccacttctgcgccgcctacggcaacgagagctccgccctcggctacgagaccaagttcgcggacgacctgcggaaggccatctacagcctgcgcaacgagaccttccacttcacgaccctcaacaaggggtccttcgactggaacgccaagctgatcggcgacatgttcagccacgaggccgcgaccgggatcgccgtggagcggacccgcttctactccaacaacctgcccatgttctaccgggagagcgacctcaagcgcatcatggaccacctgtacaacacgtaccacccccgggcctcccaggtgcccagcttcaacagcgtcttcgtgcgcaagaacttccggctgttcctctccaacaccctgaacaccaacaccagcttcgacacggaggtgtaccagaagtgggagtccggcgtctactacctgttcaaggagatctactacaacagcttcctcccgtccggggacgcccaccacctgttcttcgagggcctgcgccggatccgcaaggaggccgacaacctccccatcgtgggcaaggaggcgaagaagcggaacgccgtgcaggacttcgggcgccgctgcgacgagctgaagaacctgagcctctccgccatctgccagatgatcatgaccgagtacaacgagcagaacaacggcaaccggaaggtcaagagcacccgcgaggacaagcggaagcccgacatcttccagcactacaagatgctgctgctccgcaccctgcaggaggccttcgccatctacatccggcgcgaggagttcaagttcatcttcgacctgcccaagacgctctacgtgatgaagccggtggaggagttcctgcccaactggaagtccgggatgttcgacagcctggtcgagcgggtgaagcagtcccccgacctccagcgctggtacgtgctgtgcaagttcctgaacggccggctcctgaaccagctgagcggcgtcatccgctcctacatccagttcgcgggggacatccagcggcgcgccaaggccaaccacaaccggctctacatggacaacacccagcgcgtggagtactacagcaacgtgctggaggtcgtggacttctgcatcaagggcacctcccggttcagcaacgtgttctccgactacttccgcgacgaggacgcctacgccgactacctggacaactacctccagttcaaggacgagaagatcgcggaggtcagcagcttcgccgccctgaagaccttctgcaacgaggaggaggtgaaggccgggatctacatggacggcgagaaccccgtgatgcagcggaacatcgtcatggcgaagctgttcgggccggacgaggtgctcaagaacgtggtccccaaggtgacgcgcgaggagatcgaggagtactaccagctggagaagcagatcgccccctaccggcagaacggctactgcaagtccgaggaggaccagaagaagctgctccgcttccagcggatcaagaaccgcgtggagttccagaccatcaccgagttcagcgagatcatcaacgagctgctgggccagctcatctcctggagcttcctgcgcgagcgggacctgctctacttccagctggggttccactacctgtgcctccacaacgacaccgagaagcccgccgagtacaaggagatctcccgcgaggacggcaccgtcatccggaacgccatcctgcaccaggtggccgcgatgtacgtcgggggcctgccggtgtacacgctcgccgacaagaagctggccgccttcgagaagggggaggccgactgcaagctgagcatctccaaggacaccgcgggcgccggcaagaagatcaaggacttcttccgctacagcaagtacgtgctcatcaaggaccggatgctgaccgaccagaaccagaagtacaccatctacctggccgggctcgagctgttcgagaacacggacgagcacgacaacatcaccgacgtgcgcaagtacgtcgaccacttcaagtactacgccacctccgacgagaacgccatgagcatcctggacctctactccgagatccacgaccggttcttcacctacgacatgaagtaccagaagaacgtggcgaacatgctggagaacatcctgctccgccacttcgtgctgatccggcccgagttcttcacgggcagcaagaaggtcggggagggcaagaagatcacgtgcaaggcccgcgcccagatcgagatcgccgagaacgggatgcggtccgaggacttcacctacaagctgagcgacggcaagaagaacatctccacgtgcatgatcgcggcccgcgaccagaagtacctcaacaccgtggcccggctgctgtactacccccacgaggccaagaagtccatcgtggacacccgcgagaagaagaacaacaagaagaccaaccggggcgacgggaccttcaacaagcagaagggcaccgcccgcaaggagaaggacaacgggccccgggagttcaacgacaccggcttcagcaacaccccgttcgcggggttcgaccccttccgcaacagctga

SEQ ID NO: 11156 - RNA, 4035 nt, synthetic construct
  misc_feature 1..4035: note = Cas13a variant__Eubacterium rectale__CVRQ01000008.1__Cas13a
  source 1..4035: mol_type = other RNA
atgctgcgccgggacaaggaggtgaagaagctctacaacgtcttcaaccagatccaggtgggcaccaagcccaagaagtggaacaacgacgagaagctgagcccggaggagaacgagcgccgggcccagcagaagaacatcaagatgaagaactacaagtggcgcgaggcctgctccaagtacgtggagagctcccagcggatcatcaacgacgtcatcttctacagctaccgcaaggcgaagaacaagctgcggtacatgcgcaagaacgaggacatcctcaagaagatgcaggaggccgagaagctgtccaagttcagcgggggcaagctggaggacttcgtggcctacaccctccggaagtccctggtggtcagcaagtacgacacgcaggagttcgactccctggccgccatggtggtgttcctcgagtgcatcgggaagaacaacatcagcgaccacgagcgcgagatcgtctgcaagctgctggagctcatccggaaggacttctccaagctggaccccaacgtgaagggcagccagggggcgaacatcgtgcgctccgtccggaaccagaacatgatcgtgcagccccagggcgaccgcttcctgttcccccaggtgtacgccaaggagaacgagaccgtcaccaacaagaacgtggagaaggagggcctcaacgagttcctgctgaactacgccaacctcgacgacgagaagcgggccgagagcctgcgcaagctgcggcgcatcctcgacgtgtacttctccgcgccgaaccactacgagaaggacatggacatcaccctgagcgacaacatcgagaaggagaagttcaacgtctgggagaagcacgagtgcgggaagaaggagacgggcctgttcgtggacatccccgacgtgctcatggaggccgaggccgagaacatcaagctggacgccgtcgtggagaagcgggagcgcaaggtgctgaacgaccgggtccgcaagcagaacatcatctgctaccgctacacccgggccgtggtcgagaagtacaactccaacgagcccctcttcttcgagaacaacgcgatcaaccagtactggatccaccacatcgagaacgccgtggagcgcatcctgaagaactgcaaggccgggaagctgttcaagctccggaagggctacctggccgagaaggtgtggaaggacgccatcaacctgatcagcatcaagtacatcgcgctcgggaaggccgtctacaacttcgccctggacgacatctggaaggacaagaagaacaaggagctgggcatcgtggacgagcgcatccggaacggcatcacctccttcgactacgagatgatcaaggcccacgagaacctccagcgcgagctggccgtggacatcgcgttcagcgtcaacaacctggcccgggccgtgtgcgacatgagcaacctcgggaacaaggagtccgacttcctgctgtggaagcgcaacgacatcgccgacaagctcaagaacaaggacgacatggccagcgtgtccgcggtcctgcagttcttcggcggcaagagctcctgggacatcaacatcttcaaggacgcctacaaggggaagaagaagtacaactacgaggtgcggttcatcgacgacctgcgcaaggccatctactgcgcccggaacgagaacttccacttcaagaccgcgctcgtgaacgacgagaagtggaacacggagctgttcggcaagatcttcgagcgcgagaccgagttctgcctgaacgtcgagaaggaccggttctacagcaacaacctctacatgttctaccaggtgtccgagctgcgcaacatgctggaccacctgtacagccggtccgtgagccgcgccgcccaggtcccctcctacaacagcgtgatcgtgcggaccgccttcccggagtacatcaccaacgtcctcgggtaccagaagccctcctacgacgccgacacgctgggcaagtggtacagcgcgtgctactacctgctcaaggagatctactacaactccttcctgcagagcgaccgcgccctgcagctgttcgagaagtccgtgaagaccctcagctgggacgacaagaagcagcagcgggccgtggacaacttcaaggaccacttctccgacatcaagagcgcctgcaccagcctggcccaggtctgccagatctacatgaccgagtacaaccagcagaacaaccagatcaagaaggtgcgctccagcaacgactccatcttcgaccagcccgtgtaccagcactacaaggtcctcctgaagaaggcgatcgccaacgccttcgccgactacctgaagaacaacaaggacctcttcgggttcatcggcaagcccttcaaggccaacgagatccgcgagatcgacaaggagcagttcctgccggactggacgagccggaagtacgaggcgctgtgcatcgaggtgtccgggagccaggagctccagaagtggtacatcgtgggcaagttcctgaacgcccgctccctgaacctcatggtcggcagcatgcggtcctacatccagtacgtgaccgacatcaagcgccgggccgccagcatcgggaacgagctgcacgtgtccgtccacgacgtggagaaggtggagaagtgggtccaggtgatcgaggtgtgcagcctgctcgcgtcccgcaccagcaaccagttcgaggactacttcaacgacaaggacgactacgcccggtacctgaagtcctacgtcgacttcagcaacgtggacatgccctccgagtacagcgccctggtggacttcagcaacgaggagcagtccgacctctacgtcgaccccaagaaccccaaggtgaaccgcaacatcgtgcacagcaagctgttcgccgccgaccacatcctgcgggacatcgtcgagccggtgtccaaggacaacatcgaggagttctacagccagaaggcggagatcgcctactgcaagatcaagggcaaggagatcaccgccgaggagcagaaggccgtgctcaagtaccagaagctgaagaaccgcgtcgagctgcgggacatcgtggagtacggggagatcatcaacgagctcctgggccagctgatcaactggtccttcatgcgcgagcgggacctcctgtacttccagctggggttccactacgactgcctccgcaacgacagcaagaagcccgagggctacaagaacatcaaggtggacgagaactccatcaaggacgccatcctgtaccagatcatcggcatgtacgtcaacggggtgacggtgtacgcgcccgagaaggacggcgacaagctgaaggagcagtgcgtcaagggcggggtgggggtcaaggtgagcgccttccaccggtactccaagtacctcggcctgaacgagaagaccctgtacaacgccggcctcgagatcttcgaggtggtcgccgagcacgaggacatcatcaacctgcgcaacgggatcgaccacttcaagtactacctgggcgactaccggagcatgctctccatctacagcgaggtgttcgaccgcttcttcacctacgacatcaagtaccagaagaacgtgctgaacctgctccagaacatcctgctgcggcacaacgtcatcgtggagcccatcctcgagtccgggttcaagaccatcggcgagcagacgaagccgggcgccaagctgagcatccgctccatcaagagcgacaccttccagtacaaggtgaagggcgggaccctgatcaccgacgcgaaggacgagcggtacctcgagacgatccgcaagatcctgtactacgccgagaacgaggaggacaacctgaagaagtccgtcgtggtgaccaacgccgacaagtacgagaagaacaaggagagcgacgaccagaacaagcagaaggagaagaagaacaaggacaacaaggggaagaagaacgaggagaccaagtccgacgccgagaagaacaacaacgagcgcctcagctacaaccccttcgcgaacctgaacttcaagctgagcaactga

SEQ ID NO: 11157 - RNA, 3858 nt, synthetic construct
  misc_feature 1..3858: note = Cas13a variant__Herbinix hemicellulosilytica__CRZ35554.1__Cas13a
  source 1..3858: mol_type = other RNA
atgaagctgacccgccggcgcatcagcggcaactccgtggaccagaagatcaccgccgccttctaccgggacatgagccaggggctcctgtactacgactccgaggacaacgactgcacggacaaggtcatcgagagcatggacttcgagcgctcctggcggggccgcatcctgaagaacggggaggacgacaagaaccccttctacatgttcgtgaagggcctcgtggggagcaacgacaagatcgtctgcgagccgatcgacgtggactccgaccccgacaacctggacatcctgatcaacaagaacctcaccggcttcggccggaacctgaaggcgcccgacagcaacgacaccctggagaacctcatccgcaagatccaggccgggatccccgaggaggaggtgctgccggagctgaagaagatcaaggagatgatccagaaggacatcgtcaaccggaaggagcagctcctgaagtccatcaagaacaaccgcatccccttcagcctggagggctccaagctcgtgcccagcaccaagaagatgaagtggctgttcaagctgatcgacgtgcccaacaagacgttcaacgagaagatgctcgagaagtactgggagatctacgactacgacaagctgaaggccaacatcaccaaccggctggacaagaccgacaagaaggcccgctccatcagccgggccgtctccgaggagctccgcgagtaccacaagaacctgcggaccaactacaaccgcttcgtgagcggggaccggccggcggccggcctggacaacgggggctccgccaagtacaaccccgacaaggaggagttcctcctgttcctgaaggaggtggagcagtacttcaagaagtacttccccgtcaagagcaagcactccaacaagagcaaggacaagagcctcgtggacaagtacaagaactactgctcctacaaggtggtcaagaaggaggtgaaccgcagcatcatcaaccagctggtggccggcctgatccagcaggggaagctcctgtactacttctactacaacgacacgtggcaggaggacttcctgaactcctacggcctcagctacatccaggtcgaggaggcgttcaagaagtccgtgatgaccagcctgtcctgggggatcaaccggctgaccagcttcttcatcgacgactccaacaccgtgaagttcgacgacatcacgaccaagaaggccaaggaggccatcgagagcaactacttcaacaagctccggacctgctcccgcatgcaggaccacttcaaggagaagctggccttcttctaccccgtctacgtgaaggacaagaaggaccgcccggacgacgacatcgagaacctgatcgtgctcgtcaagaacgccatcgagagcgtgtcctacctgcgcaaccggaccttccacttcaaggagagctccctgctcgagctgctgaaggagctcgacgacaagaacagcggccagaacaagatcgactactccgtcgcggccgagttcatcaagcgcgacatcgagaacctgtacgacgtgttccgggagcagatccgcagcctgggcatcgccgagtactacaaggccgacatgatctccgactgcttcaagacgtgcgggctcgagttcgccctgtacagccccaagaacagcctgatgcccgcgttcaagaacgtgtacaagcggggcgccaacctgaacaaggcctacatccgcgacaaggggcccaaggagaccggcgaccaggggcagaactcctacaaggccctcgaggagtaccgggagctgacctggtacatcgaggtcaagaacaacgaccagagctacaacgcctacaagaacctgctccagctgatctactaccacgcgttcctgccggaggtgcgcgagaacgaggccctcatcaccgacttcatcaaccggacgaaggagtggaaccgcaaggagaccgaggagcggctgaacaccaagaacaacaagaagcacaagaacttcgacgagaacgacgacatcaccgtgaacacgtaccgctacgagtccatccccgactaccagggcgagagcctggacgactacctcaaggtcctgcagcggaagcagatggcccgcgccaaggaggtgaacgagaaggaggagggcaacaacaactacatccagttcatccgggacgtggtcgtgtgggccttcggggcgtacctggagaacaagctcaagaactacaagaacgagctgcagccgcccctgtccaaggagaacatcggcctcaacgacaccctgaaggagctgttccccgaggagaaggtcaagagccccttcaacatcaagtgccgcttctccatcagcaccttcatcgacaacaaggggaagtccaccgacaacacgagcgccgaggccgtgaagaccgacggcaaggaggacgagaaggacaagaagaacatcaagcggaaggacctcctgtgcttctacctgttcctccgcctgctggacgagaacgagatctgcaagctccagcaccagttcatcaagtaccggtgctccctgaaggagcgccgcttccccgggaaccggaccaagctggagaaggagaccgagctcctggccgagctggaggagctcatggagctggtgcgcttcacgatgcccagcatcccggagatctccgcgaaggccgagagcggctacgacaccatgatcaagaagtacttcaaggacttcatcgagaagaaggtgttcaagaaccccaagacctccaacctgtactaccacagcgactccaagacccccgtcacgcggaagtacatggccctcctgatgcgcagcgcgcccctgcacctctacaaggacatcttcaagggctactacctgatcaccaagaaggagtgcctggagtacatcaagctcagcaacatcatcaaggactaccagaactccctgaacgagctgcacgagcagctcgagcggatcaagctcaagagcgagaagcagaacgggaaggactccctgtacctggacaagaaggacttctacaaggtgaaggagtacgtggagaacctggagcaggtcgcccgctacaagcacctccagcacaagatcaacttcgagagcctgtaccggatcttccgcatccacgtggacatcgccgcccggatggtgggctacacccaggactgggagcgcgacatgcacttcctgttcaaggccctggtctacaacggggtgctcgaggagcggcgcttcgaggccatcttcaacaacaacgacgacaacaacgacggccggatcgtgaagaagatccagaacaacctgaacaacaagaaccgcgagctggtctccatgctctgctggaacaagaagctgaacaagaacgagttcggggccatcatctggaagcggaacccgatcgcgcacctgaaccacttcacccagaccgagcagaacagcaagtccagcctcgagtccctgatcaacagcctgcgcatcctcctggcctacgaccggaagcgccagaacgccgtgacgaagaccatcaacgacctgctcctgaacgactaccacatccggatcaagtgggagggccgcgtggacgagggccagatctacttcaacatcaaggagaaggaggacatcgagaacgagcccatcatccacctgaagcacctccacaagaaggactgctacatctacaagaactcctacatgttcgacaagcagaaggagtggatctgcaacgggatcaaggaggaggtctacgacaagagcatcctgaagtgcatcggcaacctgttcaagttcgactacgaggacaagaacaagtccagcgccaaccccaagcacacctga

SEQ ID NO: 11158 - RNA, 4314 nt, synthetic construct
  misc_feature 1..4314: note = Cas13a variant__Lachnospiraceae bacterium__WP_022785443.1__Cas13a
  source 1..4314: mol_type = other RNA
atgaagatcagcaaggtgcgcgaggagaaccggggcgccaagctgaccgtcaacgccaagaccgcggtggtgtccgagaaccgcagccaggaggggatcctctacaacgacccctcccggtacggcaagagccgcaagaacgacgaggaccgggaccgctacatcgagtcccggctcaagagctccgggaagctgtaccgcatcttcaacgaggacaagaacaagcgggagacggacgagctgcagtggttcctgagcgagatcgtcaagaagatcaaccgccggaacggcctggtgctctccgacatgctgagcgtggacgaccgcgccttcgagaaggccttcgagaagtacgccgagctgtcctacaccaaccggcgcaacaaggtcagcgggtccccggccttcgagacctgcggcgtggacgcggccaccgccgagcggctcaagggcatcatcagcgagacgaacttcatcaaccgcatcaagaacaacatcgacaacaaggtgtccgaggacatcatcgaccggatcatcgccaagtacctgaagaagtccctgtgccgcgagcgggtcaagcgcgggctcaagaagctgctgatgaacgcgttcgacctcccctacagcgaccccgacatcgacgtgcagcgggacttcatcgactacgtgctggaggacttctaccacgtccgcgccaagagccaggtgtcccgcagcatcaagaacatgaacatgcccgtgcagccggagggcgacgggaagttcgccatcaccgtcagcaagggcgggaccgagtccggcaacaagcggagcgccgagaaggaggccttcaagaagttcctgtccgactacgcgagcctcgacgagcgcgtgcgggacgacatgctgcgccggatgcgccggctggtggtcctctacttctacggctccgacgacagcaagctgtccgacgtgaacgagaagttcgacgtgtgggaggaccacgccgcccgccgggtcgacaaccgcgagttcatcaagctgcccctcgagaacaagctggccaacgggaagaccgacaaggacgccgagcggatccgcaagaacacggtgaaggagctgtaccggaaccagaacatcggctgctaccgccaggcggtgaaggccgtcgaggaggacaacaacgggcggtacttcgacgacaagatgctcaacatgttcttcatccaccgcatcgagtacggcgtggagaagatctacgccaacctgaagcaggtcaccgagttcaaggcccggaccggctacctgagcgagaagatctggaaggacctcatcaactacatctccatcaagtacatcgccatggggaaggcggtgtacaactacgccatggacgagctgaacgccagcgacaagaaggagatcgagctgggcaagatctccgaggagtacctcagcgggatctccagcttcgactacgagctgatcaaggccgaggagatgctgcagcgcgagaccgccgtgtacgtcgcgttcgccgcccggcacctctccagccagacggtggagctggactccgagaacagcgacttcctgctcctgaagcccaagggcaccatggacaagaacgacaagaacaagctggcctccaacaacatcctcaacttcctgaaggacaaggagaccctgcgcgacaccatcctccagtacttcgggggccacagcctgtggacggacttccccttcgacaagtacctggcgggcgggaaggacgacgtggacttcctcaccgacctgaaggacgtcatctacagcatgcgcaacgactccttccactacgccaccgagaaccacaacaacggcaagtggaacaaggagctgatcagcgccatgttcgagcacgagaccgagcggatgacggtggtgatgaaggacaagttctactccaacaacctgccgatgttctacaagaacgacgacctcaagaagctgctgatcgacctctacaaggacaacgtcgagcgcgccagccaggtgccctccttcaacaaggtgttcgtccggaagaacttccccgccctggtgcgcgacaaggacaacctggggatcgagctcgacctgaaggcggacgccgacaagggcgagaacgagctgaagttctacaacgccctctactacatgttcaaggagatctactacaacgccttcctgaacgacaagaacgtgcgggagcgcttcatcaccaaggccaccaaggtcgcggacaactacgaccggaacaaggagcgcaacctgaaggaccggatcaagagcgccgggtccgacgagaagaagaagctccgcgagcagctgcagaactacatcgccgagaacgacttcggccagcggatcaagaacatcgtccaggtgaaccccgactacaccctggcccagatctgccagctcatcatgacggagtacaaccagcagaacaacggctgcatgcagaagaagtccgccgcgcgcaaggacatcaacaaggacagctaccagcactacaagatgctgctgctcgtgaacctgcggaaggccttcctggagttcatcaaggagaactacgccttcgtgctcaagccgtacaagcacgacctgtgcgacaaggccgacttcgtgcccgacttcgcgaagtacgtcaagccctacgccgggctgatcagccgcgtggccggctccagcgagctccagaagtggtacatcgtgtcccggttcctgagccccgcccaggccaaccacatgctggggttcctccactcctacaagcagtacgtctgggacatctaccgccgggcgagcgagaccggcaccgagatcaaccactccatcgccgaggacaagatcgccggggtggacatcaccgacgtggacgccgtcatcgacctgagcgtgaagctgtgcggcacgatcagctccgagatcagcgactacttcaaggacgacgaggtgtacgccgagtacatctccagctacctcgacttcgagtacgacggcgggaactacaaggactccctgaaccgcttctgcaacagcgacgcggtcaacgaccagaaggtggccctgtactacgacggcgagcacccgaagctcaaccggaacatcatcctgtccaagctgtacggggagcgccggttcctcgagaagatcaccgaccgcgtgagccgctccgacatcgtcgagtactacaagctgaagaaggagaccagccagtaccagaccaagggcatcttcgactccgaggacgagcagaagaacatcaagaagttccaggagatgaagaacatcgtggagttccgggacctgatggactacagcgagatcgccgacgagctccagggccagctgatcaactggatctacctgcgcgagcgggacctcatgaacttccagctggggtaccactacgcctgcctgaacaacgactccaacaagcaggccacgtacgtgaccctcgactaccagggcaagaagaaccgcaagatcaacggggcgatcctgtaccagatctgcgccatgtacatcaacggcctgcccctctactacgtcgacaaggacagctccgagtggaccgtgagcgacgggaaggagtccaccggcgccaagatcggcgagttctaccggtacgccaagagcttcgagaacacgtccgactgctacgcgagcgggctggagatcttcgagaacatcagcgagcacgacaacatcaccgagctgcgcaactacatcgagcacttccggtactactccagcttcgaccgctccttcctcggcatctacagcgaggtgttcgaccggttcttcacctacgacctgaagtaccgcaagaacgtccccaccatcctgtacaacatcctcctgcagcacttcgtgaacgtgcggttcgagttcgtctccgggaagaagatgatcggcatcgacaagaaggaccgcaagatcgccaaggagaaggagtgcgcccggatcaccatccgcgagaagaacggggtgtacagcgagcagttcacgtacaagctgaagaacggcaccgtgtacgtcgacgcccgggacaagcgctacctccagtccatcatccggctgctgttctaccccgagaaggtgaacatggacgagatgatcgaggtgaaggagaagaagaagccgagcgacaacaacaccggcaaggggtactccaagcgcgaccggcagcaggaccgcaaggagtacgacaagtacaaggagaagaagaagaaggagggcaacttcctcagcgggatgggcgggaacatcaactgggacgagatcaacgcccagctgaagaactga

SEQ ID NO: 11159 - RNA, 3156 nt, synthetic construct
  misc_feature 1..3156: note = Cas13a variant__Listeria newyorkensis__WP_036091002.1__Cas13a
  source 1..3156: mol_type = other RNA
atgaagatcaccaagatgcgcgtggacggccggaccatcgtcatggagcgcacgagcaaggaggggcagctgggctacgaggggatcgacggcaacaagaccaccgagatcatcttcgacaagaagaaggagtccttctacaagagcatcctcaacaagaccgtgcggaagcccgacgagaaggagaagaaccgccggaagcaggccatcaacaaggccatcaacaaggagatcacggagctgatgctggcggtgctccaccaggaggtcccgtcccagaagctgcacaacctcaagagcctgaacaccgagtccctgaccaagctgttcaagcccaagttccagaacatgatcagctacccgccctccaagggggccgagcacgtgcagttctgcctcaccgacatcgccgtgcccgccatccgcgacctggacgagatcaagcccgactggggcatcttcttcgagaagctgaagccctacacggactgggccgagagctacatccactacaagcagaccaccatccagaagtccatcgagcagaacaagatccagagccccgactccccgcggaagctcgtcctgcagaagtacgtgaccgcgttcctgaacggcgagcccctcgggctggacctggtggccaagaagtacaagctcgccgacctggccgagagcttcaagctggtcgacctcaacgaggacaagtccgcgaactacaagatcaaggcctgcctgcagcagcaccagcgcaacatcctggacgagctcaaggaggaccccgagctgaaccagtacggcatcgaggtgaagaagtacatccagcggtacttccccatcaagcgcgccccgaaccggagcaagcacgcccgcgccgacttcctgaagaaggagctcatcgagtccacggtggagcagcagttcaagaacgcggtctaccactacgtgctggagcaggggaagatggaggcctacgagctgaccgaccccaagaccaaggacctccaggacatccggagcggcgaggccttctccttcaagttcatcaacgcctgcgccttcgcgagcaacaacctgaagatgatcctgaaccccgagtgcgagaaggacatcctcgggaagggcaacttcaagaagaacctgcccaactccaccacgcgcagcgacgtggtcaagaagatgatcccgttcttcagcgacgagctgcagaacgtgaacttcgacgaggccatctgggccatccggggctccatccagcagatccgcaacgaggtgtaccactgcaagaagcacagctggaagtccatcctcaagatcaaggggttcgagttcgagcccaacaacatgaagtacgccgacagcgacatgcagaagctgatggacaaggacatcgccaagatccccgagttcatcgaggagaagctgaagtccagcggcgtcgtgcggttctaccgccacgacgagctccagtccatctgggagatgaagcaggggttcagcctgctgaccaccaacgcgcccttcgtgccgtccttcaagcgggtctacgccaagggccacgactaccagaccagcaagaaccgctactacaacctcgacctgacgaccttcgacatcctggagtacggcgaggaggacttccgggcccgctacttcctcaccaagctggtgtactaccagcagttcatgccctggttcaccgccgacaacaacgccttccgcgacgcggccaacttcgtgctgcggctcaacaagaaccgccagcaggacgccaaggccttcatcaacatccgggaggtcgaggagggggagatgccccgcgactacatgggctacgtgcaggggcagatcgcgatccacgaggactccatcgaggacacgcccaaccacttcgagaagttcatcagccaggtcttcatcaagggcttcgaccggcacatgcgctccgccaacctgaagttcatcaagaacccgcggaaccaggggctggagcagagcgagatcgaggagatgtccttcgacatcaaggtggagcccagcttcctgaagaacaaggacgactacatcgccttctggatcttctgcaagatgctcgacgcccgccacctgtccgagctgcggaacgagatgatcaagtacgacggccacctcaccggcgagcaggagatcatcgggctggccctgctcggcgtggacagccgcgagaacgactggaagcagttcttctccagcgagcgggagtacgagaagatcatgaaggggtacgtcgtggaggagctgtaccagcgcgagccctaccggcagagcgacggcaagacccccatcctgttccgcggggtggagcaggcgcggaagtacggcaccgagacggtcatccagcgcctcttcgacgccaacccggagttcaaggtgtccaagtgcaacctggccgagtgggagcggcagaaggagaccatcgaggagaccatcaagcgccggaaggagctgcacaacgagtgggccaagaaccccaagaagccccagaacaacgccttcttcaaggagtacaaggagtgctgcgacgcgatcgacgcctacaactggcacaagaacaagaccacgctcgcctacgtgaacgagctgcaccacctcctgatcgagatcctgggccgctacgtcgggtacgtggccatcgccgaccgcgacttccagtgcatggcgaaccagtacttcaagcacagcggcatcaccgagcgggtggagtactggggcgacaaccgcctgaagtccatcaagaagctcgacaccttcctgaagaaggaggggctgttcgtcagcgagaagaacgcccggaaccacatcgcccacctcaactacctgtccctcaagagcgagtgcaccctgctgtacctgtccgagcgcctccgggagatcttcaagtacgaccgcaagctgaagaacgccgtgagcaagtccctgatcgacatcctcgaccggcacgggatgagcgtggtcttcgcgaacctgaaggagaacaagcaccgcctggtgatcaagtccctcgagccgaagaagctgcggcacctgggcggcaagaagatcgacgggggctacatcgagacgaaccaggtgagcgaggagtactgcgggatcgtcaagcgcctcctggagatgtga

SEQ ID NO: 11160 - RNA, 3363 nt, synthetic construct
  misc_feature 1..3363: note = Cas13a variant__Listeria seeligeri__WP_012985477.1__Cas13a
  source 1..3363: mol_type = other RNA
atgtggatcagcatcaagaccctgatccaccacctcggcgtgctgttcttctgcgactacatgtacaaccgccgggagaagaagatcatcgaggtcaagaccatgcgcatcacgaaggtggaggtggaccggaagaaggtcctgatctcccgcgacaagaacgggggcaagctcgtgtacgagaacgagatgcaggacaacaccgagcagatcatgcaccacaagaagtccagcttctacaagagcgtggtcaacaagaccatctgccggcccgagcagaagcagatgaagaagctggtgcacgggctgctccaggagaactcccaggagaagatcaaggtgagcgacgtcaccaagctgaacatctccaacttcctgaaccaccgcttcaagaagtccctctactacttcccggagaacagccccgacaagagcgaggagtaccggatcgagatcaacctgtcccagctgctcgaggacagcctgaagaagcagcagggcacgttcatctgctgggagtccttcagcaaggacatggagctgtacatcaactgggccgagaactacatctccagcaagaccaagctcatcaagaagtccatccgcaacaaccggatccagagcaccgagtcccgcagcgggcagctgatggaccggtacatgaaggacatcctgaacaagaacaagcccttcgacatccagagcgtgtccgagaagtaccagctcgagaagctgaccagcgccctgaaggcgacgttcaaggaggccaagaagaacgacaaggagatcaactacaagctcaagtccaccctgcagaaccacgagcgccagatcatcgaggagctgaaggagaacagcgagctcaaccagttcaacatcgagatccggaagcacctggagacctacttccccatcaagaagaccaaccgcaaggtgggcgacatccggaacctggagatcggcgagatccagaagatcgtcaaccaccgcctcaagaacaagatcgtgcagcggatcctgcaggaggggaagctggcctcctacgagatcgagagcacggtgaactccaacagcctccagaagatcaagatcgaggaggccttcgccctgaagttcatcaacgcgtgcctgttcgcctccaacaacctccgcaacatggtctacccggtgtgcaagaaggacatcctgatgatcggcgagttcaagaacagcttcaaggagatcaagcacaagaagttcatccggcagtggtcccagttcttcagccaggagatcaccgtggacgacatcgagctggcctcctgggggctccgcggcgccatcgcgcccatccggaacgagatcatccacctgaagaagcacagctggaagaagttcttcaacaaccccaccttcaaggtcaagaagtccaagatcatcaacgggaagaccaaggacgtgacgagcgagttcctgtacaaggagaccctcttcaaggactacttctactccgagctggacagcgtgcccgagctgatcatcaacaagatggagtccagcaagatcctcgactactacagctccgaccagctgaaccaggtcttcaccatcccgaacttcgagctgagcctcctgacctccgccgtgcccttcgcccccagcttcaagcgcgtgtacctgaagggcttcgactaccagaaccaggacgaggcccagcccgactacaacctcaagctgaacatctacaacgagaaggccttcaactccgaggcgttccaggcccagtacagcctgttcaagatggtctactaccaggtgttcctgccgcagttcacgaccaacaacgacctcttcaagtccagcgtcgacttcatcctgaccctgaacaaggagcgcaagggctacgccaaggccttccaggacatccggaagatgaacaaggacgagaagccctccgagtacatgagctacatccagtcccagctcatgctgtaccagaagaagcaggaggagaaggagaagatcaaccacttcgagaagttcatcaaccaggtgttcatcaaggggttcaacagcttcatcgagaagaaccgcctgacctacatctgccaccccacgaagaacaccgtgcccgagaacgacaacatcgagatcccgttccacaccgacatggacgactccaacatcgccttctggctcatgtgcaagctgctggacgcgaagcagctcagcgagctgcggaacgagatgatcaagttctcctgcagcctgcagtccaccgaggagatcagcacgttcaccaaggcccgcgaggtcatcggcctcgccctgctgaacggggagaagggctgcaacgactggaaggagctgttcgacgacaaggaggcctggaagaagaacatgagcctctacgtgtccgaggagctgctccagagcctgccctacacccaggaggacggccagacccccgtgatcaaccggtccatcgacctggtcaagaagtacgggacggagaccatcctcgagaagctgttcagctccagcgacgactacaaggtgtccgccaaggacatcgcgaagctgcacgagtacgacgtgaccgagaagatcgcccagcaggagagcctccacaagcagtggatcgagaagcccggcctggcccgcgactccgcctggaccaagaagtaccagaacgtcatcaacgacatcagcaactaccagtgggccaagacgaaggtggagctgacccaggtgcggcacctccaccagctgaccatcgacctgctctcccgcctggcggggtacatgagcatcgccgaccgggacttccagttctccagcaactacatcctggagcgcgagaactccgagtaccgggtcaccagctggatcctcctgtccgagaacaagaacaagaacaagtacaacgactacgagctgtacaacctcaagaacgccagcatcaaggtgtccagcaagaacgacccgcagctgaaggtggacctgaagcagctccgcctgaccctggagtacctcgagctgttcgacaaccggctgaaggagaagcgcaacaacatcagccacttcaactacctcaacggccagctggggaactccatcctggagctgttcgacgacgcccgggacgtcctcagctacgaccgcaagctgaagaacgcggtgtccaagagcctcaaggagatcctgtccagccacggcatggaggtgacgttcaagcccctgtaccagaccaaccaccacctcaagatcgacaagctgcagcccaagaagatccaccacctgggcgagaagtccaccgtcagctccaaccaggtgagcaacgagtactgccagctcgtgcggaccctgctgacgatgaagtga

SEQ ID NO: 11161 - RNA, 3465 nt, synthetic construct
  misc_feature 1..3465: note = Cas13a variant__Paludibacter propionicigenes__WP_013443710.1__Cas13a
  source 1..3465: mol_type = other RNA
atgcgcgtgagcaaggtcaaggtgaaggacggcgggaaggacaagatggtgctggtccaccggaagaccaccggcgcccagctcgtgtactccgggcagcccgtgagcaacgagacgtccaacatcctgccggagaagaagcgccagagcttcgacctgtccaccctcaacaagaccatcatcaagttcgacaccgccaagaagcagaagctgaacgtcgaccagtacaagatcgtggagaagatcttcaagtaccccaagcaggagctgcccaagcagatcaaggcggaggagatcctccccttcctgaaccacaagttccaggagccggtgaagtactggaagaacggcaaggaggagagcttcaacctgacgctcctgatcgtcgaggccgtgcaggcccaggacaagcggaagctgcagccctactacgactggaagacctggtacatccagaccaagtccgacctcctgaagaagtccatcgagaacaaccgcatcgacctgaccgagaacctcagcaagcggaagaaggccctgctggcctgggagacggagttcaccgcgagcgggtccatcgacctcacccactaccacaaggtgtacatgaccgacgtcctgtgcaagatgctgcaggacgtgaagcccctcacggacgacaagggcaagatcaacaccaacgcctaccaccgcggcctgaagaaggccctgcagaaccaccagcccgccatcttcgggacccgggaggtgccgaacgaggcgaaccgcgccgacaaccagctcagcatctaccacctggaggtcgtgaagtacctggagcactacttccccatcaagacctccaagcggcgcaacacggccgacgacatcgcccactacctcaaggcccagaccctgaagaccaccatcgagaagcagctggtgaacgcgatccgggccaacatcatccagcagggcaagacgaaccaccacgagctcaaggccgacaccaccagcaacgacctgatccgcatcaagaccaacgaggccttcgtcctgaacctcacggggacctgcgccttcgcggccaacaacatccggaacatggtggacaacgagcagaccaacgacatcctgggcaagggggacttcatcaagtccctgctcaaggacaacaccaacagccagctgtactccttcttcttcggcgagggcctgagcacgaacaaggccgagaaggagacccagctctgggggatccgcggcgccgtgcagcagatccggaacaacgtcaaccactacaagaaggacgccctgaagaccgtgttcaacatctccaacttcgagaaccccaccatcacggaccccaagcagcagaccaactacgcggacaccatctacaaggcccgcttcatcaacgagctggagaagatcccggaggccttcgcccagcagctcaagaccgggggcgccgtgagctactacacgatcgagaacctcaagagcctgctgaccaccttccagttctccctgtgccggagcaccatccccttcgcgcccggcttcaagaaggtcttcaacgggggcatcaactaccagaacgccaagcaggacgagtccttctacgagctgatgctcgagcagtacctgcgcaaggagaacttcgccgaggagagctacaacgcccggtacttcatgctgaagctgatctacaacaacctcttcctgcccgggttcaccacggaccgcaaggcgttcgccgactccgtgggcttcgtccagatgcagaacaagaagcaggccgagaaggtgaacccgcggaagaaggaggcctacgccttcgaggcggtgcgccccatgaccgccgccgacagcatcgccgactacatggcctacgtccagtccgagctgatgcaggagcagaacaagaaggaggagaaggtggcggaggagacccgcatcaacttcgagaagttcgtgctccaggtcttcatcaaggggttcgacagcttcctgcgggccaaggagttcgacttcgtgcagatgccccagccccagctgaccgccacggcctccaaccagcagaaggccgacaagctcaaccagctggaggcgagcatcaccgccgactgcaagctgaccccgcagtacgccaaggccgacgacgcgacccacatcgccttctacgtgttctgcaagctcctggacgccgcccacctgtccaacctccgcaacgagctgatcaagttccgggagagcgtcaacgagttcaagttccaccacctcctggagatcatcgagatctgcctgctgtccgccgacgtggtgcccacggactaccgcgacctctacagctccgaggcggactgcctggcccggctgcgccccttcatcgagcagggcgccgacatcaccaactggagcgacctcttcgtccagtccgacaagcacagccccgtgatccacgccaacatcgagctgtccgtgaagtacggcaccaccaagctgctcgagcagatcatcaacaaggacacgcagttcaagaccaccgaggccaacttcaccgcgtggaacacggcccagaagtccatcgagcagctgatcaagcagcgggaggaccaccacgagcagtgggtcaaggccaagaacgccgacgacaaggagaagcaggagcgcaagcgggagaagtccaacttcgcccagaagttcatcgagaagcacggggacgactacctggacatctgcgactacatcaacacctacaactggctcgacaacaagatgcacttcgtgcacctgaaccgcctgcacggcctcaccatcgagctgctggggcggatggcgggcttcgtggccctcttcgaccgcgacttccagttcttcgacgagcagcagatcgccgacgagttcaagctgcacgggttcgtcaacctgcacagcatcgacaagaagctcaacgaggtgccgaccaagaagatcaaggagatctacgacatccggaacaagatcatccagatcaacggcaacaagatcaacgagagcgtgcgcgccaacctgatccagttcatcagcagcaagcggaactactacaacaacgcgttcctgcacgtctccaacgacgagatcaaggagaagcagatgtacgacatccgcaaccacatcgcccacttcaactacctcacgaaggacgccgccgacttcagcctgatcgacctgatcaacgagctccgggagctgctgcactacgaccgcaagctcaagaacgccgtgtccaaggcgttcatcgacctgttcgacaagcacggcatgatcctgaagctcaagctgaacgccgaccacaagctgaaggtggagagcctcgagcccaagaagatctaccacctggggtccagcgccaaggacaagcccgagtaccagtactgcaccaaccaggtcatgatggcctactgcaacatgtgccggtccctgctcgagatgaagaagtga

SEQ ID NO: 11162 - RNA, 3858 nt, synthetic construct
  misc_feature 1..3858: note = Cas13a variant__Rhodobacter capsulatus__ETD76934.1__Cas13a
  source 1..3858: mol_type = other RNA
atgcagatcggcaaggtgcaggggcgcaccatcagcgagttcggcgaccccgccgggggcctgaagcggaagatctccaccgacgggaagaaccgcaaggagctcccggcccacctgagctccgaccccaaggcgctgatcggccagtggatcagcggcatcgacaagatctaccggaagcccgactcccgcaagagcgacgggaaggccatccactcccccacgccgagcaagatgcagttcgacgcccgggacgacctcggcgaggccttctggaagctggtctccgaggccgggctggcgcaggacagcgactacgaccagttcaagcgccggctccacccctacggcgacaagttccagcccgccgactccggggccaagctgaagttcgaggccgaccccccggagccccaggcgttccacggccgctggtacggcgccatgagcaagcgggggaacgacgccaaggagctggccgccgcgctctacgagcacctgcacgtggacgagaagcgcatcgacggccagcccaagcggaaccccaagaccgacaagttcgccccggggctggtggtcgcccgcgccctcggcatcgagtccagcgtgctgccccggggcatggcccgcctggcgcggaactggggggaggaggagatccagacctacttcgtggtcgacgtggccgcctccgtgaaggaggtcgccaaggccgcggtgagcgccgcccaggccttcgaccccccccgccaggtgtccggccggagcctctccccgaaggtcgggttcgccctggcggagcacctggagcgcgtgaccggcagcaagcggtgcagcttcgaccccgccgccgggccctccgtgctcgccctgcacgacgaggtcaagaagacgtacaagcgcctgtgcgcgcggggcaagaacgccgcccgcgccttccccgccgacaagaccgagctcctggcgctgatgcgccacacccacgagaaccgggtgcgcaaccagatggtgcggatgggccgcgtcagcgagtaccgggggcagcaggccggcgacctcgcccagtcccactactggaccagcgccgggcagacggagatcaaggagtccgagatcttcgtgcgcctgtgggtgggcgccttcgcgctggccgggcggagcatgaaggcctggatcgacccgatgggcaagatcgtcaacaccgagaagaacgaccgcgacctcaccgccgccgtgaacatccggcaggtgatctccaacaaggagatggtcgcggaggccatggcccgccggggcatctacttcggggagacccccgagctggaccgcctgggcgccgaggggaacgagggcttcgtgttcgcgctcctgcggtacctgcgcgggtgccggaaccagacgttccacctcggcgcccgcgccggcttcctgaaggagatccggaaggagctggagaagacccgctgggggaaggccaaggaggccgagcacgtcgtgctcaccgacaagaccgtggcggccatccgggccatcatcgacaacgacgccaaggccctgggcgcgcgcctgctcgccgacctgagcggggccttcgtcgcccactacgcctccaaggagcacttcagcacgctgtactccgagatcgtgaaggcggtgaaggacgcccccgaggtcagctccggcctcccccgcctgaagctgctcctgaagcgggccgacggcgtgcgcgggtacgtgcacggcctgcgggacacccgcaagcacgccttcgcgaccaagctcccgcccccccccgccccgcgggagctggacgaccccgccaccaaggcccgctacatcgccctgctgcggctctacgacgggcccttccgcgcgtacgccagcggcatcacggggaccgccctggccggcccggccgcgcgggccaaggaggccgccaccgccctggcgcagtccgtcaacgtgaccaaggcctacagcgacgtgatggagggccgctccagccggctccgcccccccaacgacggggagacgctgcgggagtacctgtccgccctcaccggcgagaccgccaccgagttccgcgtccagatcgggtacgagagcgacagcgagaacgcccggaagcaggcggagttcatcgagaactaccgccgggacatgctggccttcatgttcgaggactacatccgcgccaagggcttcgactggatcctgaagatcgagcccggggccacggcgatgacccgggccccggtgctccccgagcccatcgacacccgcggccagtacgagcactggcaggccgccctgtacctggtgatgcacttcgtccccgcctccgacgtgagcaacctcctgcaccagctgcggaagtgggaggcgctccagggcaagtacgagctggtgcaggacggggacgccaccgaccaggccgacgcccgccgcgaggccctggacctcgtcaagcggttccgcgacgtgctggtgctgttcctcaagacgggcgaggcgcggttcgaggggcgcgccgccccgttcgacctgaagcccttccgggccctgttcgccaaccccgcgaccttcgaccgcctcttcatggccacccccaccacggcccggccggccgaggacgaccccgagggcgacggggcgtccgagcccgagctgcgcgtcgcccggaccctgcgcggcctccggcagatcgcccgctacaaccacatggccgtgctgagcgacctgttcgccaagcacaaggtgcgggacgaggaggtcgcgcgcctcgccgagatcgaggacgagacccaggagaagtcccagatcgtggccgcccaggagctgcggaccgacctgcacgacaaggtgatgaagtgccaccccaagaccatcagcccggaggagcgccagtcctacgccgcggccatcaagacgatcgaggagcaccggttcctcgtcggccgcgtgtacctgggggaccacctgcggctccaccgcctgatgatggacgtgatcggccgcctgatcgactacgccggggcctacgagcgggacaccggcaccttcctcatcaacgccagcaagcagctgggggcgggcgccgactgggccgtcaccatcgccggcgcggccaacacggacgcccgcacccagacccggaaggacctggcccacttcaacgtgctcgaccgcgccgacgggacccccgacctgacggcgctggtgaaccgggcccgcgagatgatggcctacgaccggaagcgcaagaacgccgtcccccggtccatcctcgacatgctggcccgcctgggcctcaccctgaagtggcagatgaaggaccacctgctccaggacgcgaccatcacccaggccgccatcaagcacctggacaaggtgcggctgacggtggggggccccgccgccgtcaccgaggcgcgcttcagccaggactacctccagatggtggccgccgtgttcaacggctccgtccagaacccgaagccccggcgccgggacgacggggacgcctggcacaagccccccaagccggccaccgcgcagagccagcccgaccagaagcccccgaacaaggccccctccgccggcagccgcctgccccccccgcaggtgggggaggtgtacgagggcgtcgtggtgaaggtcatcgacaccgggtccctgggcttcctcgccgtggagggcgtggcggggaacatcggcctgcacatcagccggctgcgccggatccgcgaggacgccatcatcgtcgggcggcgctaccgcttccgggtggagatctacgtgccccccaagtccaacacgagcaagctcaacgccgccgacctggtccgcatcgactga

SEQ ID NO: 11163 - RNA, 1578 nt, synthetic construct
  misc_feature 1..1578: note = Cas13a variant__Corynebacterium ulcerans__WP_038617242.1__Cas13
  source 1..1578: mol_type = other RNA
atgcccaagtactgcctgaccgcccgcttcccgctcggcgtgtacctggggcacaccggcgacgccaaccgggacgcgtaccccgaccccgcccgcctgcacgccgccctcatgaacgccgcggcccagggggtccacgccgaggaggaccccaacgagcaccagctgcggccgagccagcagtccctgcaggccctccagtggctggaggcgcacccgcccacgggcctggccatgcccgagcagcagtggctcagccccgacacctcccgcatgatgtaccggaacgtggggagcgtgaagatcgacaagaccggcgtcacccgcgccacggagaaccgggccgtgtccgacggcgtgagcgtcaacggggcctacggctacatctgggacgagatgcccgtggacatcgcggaggccatcaccgccctgctgcccgacgtggcctgcctcggggaggcctccagcctggtcgtgctggagcagcaggagatcgaggcgaccctcaccctggacccccaggccacggccttctccaccgagcgcgtgcaggtccggatcgccctgccgggccgcacccagcacctccgggaggtgttccacgcccgctacgggaagaagccgcccagcaagaaggcggacaagttcctgaaggacgaccccatccacgacccgcccatccccaaggaccacctgggcaccgcccggtacctccgcgtgaacgccgccgacaaggagtgcgtcacgccctggaccaaggtgatcctgctggaggtgcacggcaagcagctcggggccaaggagcaggtccgggcggccgtggccctgcaccgcgccctgatcgcgcggatccgcaccgacgtgtcccccgtcatcaccggccggtacgccgccggggcccagcgccccgccaacaacctcgcgatccagtacatcccccaccggcacctggaggccctgggcctcaagacgagcgccttcgccctgctggtgccccaggacgccgactccaccgtgtacgagcagctcaaccaggcgctgaccggcccgttccccctgcgcagcgggggcaagctcctgtgccagctgaagtacaacgggcacgtcttccgcggcgacgccttctggcccgcgccccagccggggaccatccggatgtgggagcccctcaacgtgttcatccccgagtcccgcccgcacaacaagcagcagggcgtcctgtggcggctggccgacgccggcctcctgagcgtggccttcgtgtggcgcgacaacttccccacgaaggagaccgggcccgcccggtacgtcgagctgcgcgacgccgcctacaacgcggacgtgcggatcttccacgaccaccccgtgtcccgcaacacccggcgcttcgtccaccggaccaaccgcagcctcacgatccagccgtggcggggcctggtgcacctggggtccctccagcaggaccgcgccatcatcgccctgggccagagccggcacctcgggggcggcctgctgatccccgtggacatcccccgcagcgagttcgagaccatgacctccgagatgacccacgcctga

SEQ ID NO: 11164 - RNA, 3675 nt, synthetic construct
  misc_feature 1..3675: note = Cas13b variant__Bergeyella zoohelcum__WP_002664492.1__Cas13b
  source 1..3675: mol_type = other RNA
atggagaacaagaccagcctgggcaacaacatctactacaaccccttcaagccgcaggacaagtcctacttcgccgggtacttcaacgccgcgatggagaacaccgacagcgtgttccgcgagctcggcaagcggctgaaggggaaggagtacacgtccgagaacttcttcgacgccatcttcaaggagaacatcagcctggtcgagtacgagcgctacgtgaagctcctgtccgactacttccccatggcccggctgctcgacaagaaggaggtgcccatcaaggagcgcaaggagaacttcaagaagaacttcaagggcatcatcaaggccgtccgggacctgcgcaacttctacacccacaaggagcacggggaggtggagatcaccgacgagatcttcggcgtgctggacgagatgctcaagagcaccgtcctgacggtgaagaagaagaaggtgaagaccgacaagaccaaggagatcctgaagaagtccatcgagaagcagctcgacatcctgtgccagaagaagctggagtacctccgggacaccgcccgcaagatcgaggagaagcggcgcaaccagcgggagcgcggcgagaaggagctggtcgcgcccttcaagtacagcgacaagcgggacgacctgatcgccgccatctacaacgacgccttcgacgtgtacatcgacaagaagaaggactccctcaaggagagctccaaggcgaagtacaacaccaagagcgacccgcagcaggaggagggggacctgaagatccccatctccaagaacggcgtggtcttcctgctcagcctgttcctgaccaagcaggagatccacgccttcaagtccaagatcgccgggttcaaggccaccgtgatcgacgaggccaccgtgagcgaggcgacggtctcccacggcaagaacagcatctgcttcatggccacccacgagatcttctcccacctcgcctacaagaagctgaagcgcaaggtgcggaccgccgagatcaactacggggaggccgagaacgcggagcagctgagcgtgtacgccaaggagaccctcatgatgcagatgctggacgagctgagcaaggtccccgacgtggtgtaccagaacctctccgaggacgtccagaagacgttcatcgaggactggaacgagtacctgaaggagaacaacggcgacgtgggcaccatggaggaggagcaggtcatccaccccgtgatccgcaagcggtacgaggacaagttcaactacttcgccatccgcttcctggacgagttcgcccagttcccgaccctccggttccaggtgcacctggggaactacctgcacgacagccgccccaaggagaacctcatctccgaccggcgcatcaaggagaagatcaccgtcttcggccgcctgagcgagctggagcacaagaaggccctcttcatcaagaacacggagaccaacgaggaccgggagcactactgggagatcttccccaaccccaactacgacttcccgaaggagaacatctccgtgaacgacaaggacttccccatcgcggggagcatcctggaccgcgagaagcagcccgtggccggcaagatcggcatcaaggtcaagctgctcaaccagcagtacgtgtccgaggtggacaaggccgtcaaggcccaccagctgaagcagcggaaggccagcaagccctccatccagaacatcatcgaggagatcgtgccgatcaacgagagcaaccccaaggaggcgatcgtgttcgggggccagcccaccgcctacctgtccatgaacgacatccacagcatcctctacgagttcttcgacaagtgggagaagaagaaggagaagctggagaagaagggggagaaggagctgcgcaaggagatcggcaaggagctcgagaagaagatcgtcgggaagatccaggcccagatccagcagatcatcgacaaggacaccaacgccaagatcctgaagccctaccaggacggcaactccacggcgatcgacaaggagaagctgatcaaggacctgaagcaggagcagaacatcctccagaagctgaaggacgagcagaccgtgcgggagaaggagtacaacgacttcatcgcctaccaggacaagaaccgcgagatcaacaaggtgcgggaccgcaaccacaagcagtacctgaaggacaacctcaagcggaagtacccggaggcccccgcccgcaaggaggtcctgtactaccgggagaagggcaaggtggccgtgtggctggcgaacgacatcaagcgcttcatgcccaccgacttcaagaacgagtggaagggggagcagcacagcctcctgcagaagtccctggcctactacgagcagtgcaaggaggagctcaagaacctgctgcccgagaaggtcttccagcacctcccgttcaagctgggcgggtacttccagcagaagtacctgtaccagttctacacgtgctacctcgacaagcggctggagtacatcagcggcctggtgcagcaggccgagaacttcaagtccgagaacaaggtgttcaagaaggtcgagaacgagtgcttcaagttcctcaagaagcagaactacacgcacaaggagctggacgcccgcgtgcagagcatcctggggtaccccatcttcctcgagcggggcttcatggacgagaagcccaccatcatcaagggcaagaccttcaaggggaacgaggccctgttcgcggactggttccgctactacaaggagtaccagaacttccagaccttctacgacacggagaactaccccctggtggagctcgagaagaagcaggccgaccggaagcgcaagaccaagatctaccagcagaagaagaacgacgtcttcaccctgctgatggccaagcacatcttcaagtccgtgttcaagcaggacagcatcgaccagttcagcctcgaggacctgtaccagtcccgggaggagcgcctgggcaaccaggagcgcgcccggcagaccggggagcgcaacacgaactacatctggaacaagaccgtggacctcaagctgtgcgacggcaagatcaccgtcgagaacgtgaagctgaagaacgtgggggacttcatcaagtacgagtacgaccagcgggtccaggccttcctcaagtacgaggagaacatcgagtggcaggcgttcctgatcaaggagagcaaggaggaggagaactacccgtacgtggtggagcgcgagatcgagcagtacgagaaggtccggcgcgaggagctgctcaaggaggtgcacctgatcgaggagtacatcctggagaaggtgaaggacaaggagatcctcaagaagggcgacaaccagaacttcaagtactacatcctgaacggcctgctcaagcagctgaagaacgaggacgtcgagtcctacaaggtgttcaacctgaacaccgagcccgaggacgtgaacatcaaccagctcaagcaggaggccaccgacctggagcagaaggccttcgtcctgacgtacatccggaacaagttcgcccacaaccagctccccaagaaggagttctgggactactgccaggagaagtacgggaagatcgagaaggagaagacctacgcggagtacttcgccgaggtgttcaagaaggagaaggaggccctgatcaagtga

SEQ ID NO: 11165 - RNA, 3675 nt, synthetic construct
  misc_feature 1..3675: note = Cas13b variant__Bergeyella zoohelcum__WP_002664492.1 modified__Cas13b(R116A,H121A,R1177A,H1182A)
  source 1..3675: mol_type = other RNA
atggagaacaagaccagcctgggcaacaacatctactacaaccccttcaagccgcaggacaagtcctacttcgccgggtacttcaacgccgcgatggagaacaccgacagcgtgttccgcgagctcggcaagcggctgaaggggaaggagtacacgtccgagaacttcttcgacgccatcttcaaggagaacatcagcctggtcgagtacgagcgctacgtgaagctcctgtccgactacttccccatggcccggctgctcgacaagaaggaggtgcccatcaaggagcgcaaggagaacttcaagaagaacttcaagggcatcatcaaggccgtccgggacctggccaacttctacaccgcgaaggagcacggggaggtggagatcaccgacgagatcttcggcgtgctggacgagatgctcaagagcaccgtcctgacggtgaagaagaagaaggtgaagaccgacaagaccaaggagatcctgaagaagtccatcgagaagcagctcgacatcctgtgccagaagaagctggagtacctccgcgacaccgcccggaagatcgaggagaagcgccggaaccagcgcgagcggggcgagaaggagctggtcgcccccttcaagtacagcgacaagcgcgacgacctgatcgccgcgatctacaacgacgccttcgacgtgtacatcgacaagaagaaggactccctcaaggagagctccaaggccaagtacaacaccaagagcgacccgcagcaggaggagggggacctgaagatccccatctccaagaacggcgtggtcttcctgctcagcctgttcctgaccaagcaggagatccacgccttcaagtccaagatcgccgggttcaaggcgaccgtgatcgacgaggccaccgtgagcgaggccacggtctcccacggcaagaacagcatctgcttcatggccacccacgagatcttctcccacctcgcctacaagaagctgaagcggaaggtgcgcaccgcggagatcaactacggggaggccgagaacgccgagcagctgagcgtgtacgccaaggagaccctcatgatgcagatgctggacgagctgagcaaggtccccgacgtggtgtaccagaacctctccgaggacgtccagaagacgttcatcgaggactggaacgagtacctgaaggagaacaacggcgacgtgggcaccatggaggaggagcaggtcatccaccccgtgatccggaagcgctacgaggacaagttcaactacttcgccatccggttcctggacgagttcgcgcagttcccgaccctccgcttccaggtgcacctggggaactacctgcacgacagccggcccaaggagaacctcatctccgaccgccggatcaaggagaagatcaccgtcttcggccgcctgagcgagctggagcacaagaaggccctcttcatcaagaacacggagaccaacgaggaccgcgagcactactgggagatcttccccaaccccaactacgacttcccgaaggagaacatctccgtgaacgacaaggacttccccatcgccgggagcatcctggaccgggagaagcagcccgtggccggcaagatcggcatcaaggtcaagctgctcaaccagcagtacgtgtccgaggtggacaaggccgtcaaggcgcaccagctgaagcagcgcaaggccagcaagccctccatccagaacatcatcgaggagatcgtgccgatcaacgagagcaaccccaaggaggccatcgtgttcgggggccagcccaccgcctacctgtccatgaacgacatccacagcatcctctacgagttcttcgacaagtgggagaagaagaaggagaagctggagaagaagggggagaaggagctgcggaaggagatcggcaaggagctcgagaagaagatcgtcgggaagatccaggcgcagatccagcagatcatcgacaaggacaccaacgccaagatcctgaagccctaccaggacggcaactccacggccatcgacaaggagaagctgatcaaggacctgaagcaggagcagaacatcctccagaagctgaaggacgagcagaccgtgcgcgagaaggagtacaacgacttcatcgcctaccaggacaagaaccgggagatcaacaaggtgcgcgaccggaaccacaagcagtacctgaaggacaacctcaagcgcaagtacccggaggcccccgcgcggaaggaggtcctgtactaccgcgagaagggcaaggtggccgtgtggctggccaacgacatcaagcggttcatgcccaccgacttcaagaacgagtggaagggggagcagcacagcctcctgcagaagtccctggcctactacgagcagtgcaaggaggagctcaagaacctgctgcccgagaaggtcttccagcacctcccgttcaagctgggcgggtacttccagcagaagtacctgtaccagttctacacgtgctacctcgacaagcgcctggagtacatcagcggcctggtgcagcaggccgagaacttcaagtccgagaacaaggtgttcaagaaggtcgagaacgagtgcttcaagttcctcaagaagcagaactacacgcacaaggagctggacgcgcgggtgcagagcatcctggggtaccccatcttcctcgagcgcggcttcatggacgagaagcccaccatcatcaagggcaagaccttcaaggggaacgaggccctgttcgccgactggttccggtactacaaggagtaccagaacttccagaccttctacgacacggagaactaccccctggtggagctcgagaagaagcaggccgaccgcaagcggaagaccaagatctaccagcagaagaagaacgacgtcttcaccctgctgatggccaagcacatcttcaagtccgtgttcaagcaggacagcatcgaccagttcagcctcgaggacctgtaccagtcccgcgaggagcggctgggcaaccaggagcgcgcgcgccagaccggggagcggaacacgaactacatctggaacaagaccgtggacctcaagctgtgcgacggcaagatcaccgtcgagaacgtgaagctgaagaacgtgggggacttcatcaagtacgagtacgaccagcgcgtccaggccttcctcaagtacgaggagaacatcgagtggcaggccttcctgatcaaggagagcaaggaggaggagaactacccgtacgtggtggagcgggagatcgagcagtacgagaaggtccgccgggaggagctgctcaaggaggtgcacctgatcgaggagtacatcctggagaaggtgaaggacaaggagatcctcaagaagggcgacaaccagaacttcaagtactacatcctgaacggcctgctcaagcagctgaagaacgaggacgtcgagtcctacaaggtgttcaacctgaacaccgagcccgaggacgtgaacatcaaccagctcaagcaggaggccaccgacctggagcagaaggcgttcgtcctgacgtacatcgccaacaagttcgccgccaaccagctccccaagaaggagttctgggactactgccaggagaagtacgggaagatcgagaaggagaagacctacgccgagtacttcgcggaggtgttcaagaaggagaaggaggccctgatcaagtga

SEQ ID NO: 11166 - RNA, 3384 nt, synthetic construct
  misc_feature 1..3384: note = Cas13b variant__Prevotella buccae__WP_004343973.1__Cas13b
  source 1..3384: mol_type = other RNA
atgcagaagcaggacaagctgttcgtggaccgcaagaagaacgccatcttcgccttccccaagtacatcaccatcatggagaacaaggagaagccggagcccatctactacgagctcaccgacaagcacttctgggcggccttcctgaacctggcccggcacaacgtctacacgaccatcaaccacatcaaccgccggctcgagatcgccgagctgaaggacgacggctacatgatggggatcaagggcagctggaacgagcaggccaagaagctggacaagaaggtgcgcctccgggacctgatcatgaagcacttccccttcctggaggcggccgcctacgagatgaccaacagcaagagccccaacaacaaggagcagcgcgagaaggagcagtccgaggccctcagcctgaacaacctgaagaacgtgctgttcatcttcctggagaagctgcaggtcctccggaactactactcccactacaagtacagcgaggagtccccgaagcccatcttcgagaccagcctgctgaagaacatgtacaaggtgttcgacgcgaacgtgcgcctcgtcaagcgggactacatgcaccacgagaacatcgacatgcagcgcgacttcacgcacctgaaccggaagaagcaggtcgggcgcaccaagaacatcatcgactcccccaacttccactaccacttcgccgacaaggagggcaacatgaccatcgccgggctgctgttcttcgtgagcctgttcctggacaagaaggacgccatctggatgcagaagaagctcaagggcttcaaggacggccggaacctgcgcgagcagatgaccaacgaggtgttctgccggtcccgcatcagcctgcccaagctcaagctggagaacgtgcagacgaaggactggatgcagctggacatgctcaacgagctggtgcggtgcccgaagtccctgtacgagcgcctccgggagaaggaccgcgagagcttcaaggtccccttcgacatcttctccgacgactacaacgccgaggaggagcccttcaagaacaccctggtgcggcaccaggaccgcttcccctacttcgtgctgcgctacttcgacctcaacgagatcttcgagcagctgcggttccagatcgacctggggacctaccacttcagcatctacaacaagcgcatcggcgacgaggacgaggtccggcacctcacccaccacctgtacgggttcgcgcgcatccaggacttcgccccgcagaaccagcccgaggagtggcggaagctggtgaaggacctcgaccacttcgagacgtcccaggagccctacatcagcaagaccgcgccccactaccacctggagaacgagaagatcggcatcaagttctgctccgcccacaacaacctgttcccgagcctccagaccgacaagacctgcaacgggcgcagcaagttcaacctgggcacgcagttcaccgccgaggccttcctgtccgtgcacgagctcctgcccatgatgttctactacctgctgctcaccaaggactacagccggaaggagtccgccgacaaggtcgagggcatcatccgcaaggagatcagcaacatctacgccatctacgacgccttcgccaacaacgagatcaactccatcgcggacctgacccggcgcctgcagaacacgaacatcctccaggggcacctccccaagcagatgatcagcatcctgaagggccggcagaaggacatggggaaggaggccgagcgcaagatcggcgagatgatcgacgacacccagcggcgcctcgacctgctgtgcaagcagaccaaccagaagatccggatcggcaagcgcaacgccgggctcctgaagtccggcaagatcgccgactggctggtgaacgacatgatgcggttccagcccgtgcagaaggaccagaacaacatcccgatcaacaacagcaaggccaactccaccgagtaccgcatgctccagcgggcgctggccctgttcgggagcgagaacttccgcctcaaggcctacttcaaccagatgaacctggtcggcaacgacaacccccaccccttcctggccgagacgcagtgggagcaccagaccaacatcctctccttctaccgcaactacctggaggcgcggaagaagtacctgaaggggctcaagccccagaactggaagcagtaccagcacttcctgatcctgaaggtgcagaagaccaaccgcaacaccctcgtgacgggctggaagaacagcttcaacctgccgcggggcatcttcacccagcccatccgcgagtggttcgagaagcacaacaactccaagcggatctacgaccagatcctgagcttcgaccgcgtcgggttcgtggccaaggccatccccctctacttcgccgaggagtacaaggacaacgtccagcccttctacgactacccgttcaacatcggcaaccggctgaagcccaagaagcgccagttcctggacaagaaggagcgggtggagctctggcagaagaacaaggagctgttcaagaactacccctccgagaagaagaagaccgacctggcctacctcgacttcctgagctggaagaagttcgagcgcgagctgcggctcatcaagaaccaggacatcgtgacctggctgatgttcaaggagctgttcaacatggcgacggtcgaggggctcaagatcggcgagatccacctccgcgacatcgacaccaacaccgccaacgaggagtccaacaacatcctgaaccggatcatgccgatgaagctccccgtgaagacctacgagacggacaacaaggggaacatcctgaaggagcgccccctggccaccttctacatcgaggagaccgagaccaaggtgctcaagcagggcaacttcaaggccctggtcaaggaccggcgcctgaacggcctcttcagcttcgccgagaccacggacctgaacctggaggagcaccccatctccaagctcagcgtggacctggagctgatcaagtaccagaccacccggatcagcatcttcgagatgaccctcgggctggagaagaagctgatcgacaagtactccacgctcccgaccgacagcttccgcaacatgctggagcggtggctgcagtgcaaggcgaaccgccccgagctcaagaactacgtgaactccctgatcgccgtccggaacgccttcagccacaaccagtaccccatgtacgacgccaccctgttcgccgaggtgaagaagttcaccctcttcccctccgtggacacgaagaagatcgagctgaacatcgcgccgcagctgctcgagatcgtcggcaaggccatcaaggagatcgagaagtccgagaacaagaactga

SEQ ID NO: 11167 - RNA, 3273 nt, synthetic construct
  misc_feature 1..3273: note = Cas13b variant__Prevotella sp.__WP_044065294__Cas13b
  source 1..3273: mol_type = other RNA
atgaacatccccgccctggtggagaaccagaagaagtacttcggcacctacagcgtcatggccatgctcaacgcgcagaccgtgctggaccacatccagaaggtggccgacatcgagggggagcagaacgagaacaacgagaacctgtggttccacccggtcatgtcccacctctacaacgccaagaacggctacgacaagcagcccgagaagacgatgttcatcatcgagcgcctgcagagctacttccccttcctgaagatcatggccgagaaccagcgggagtactccaacgggaagtacaagcagaaccgcgtggaggtgaacagcaacgacatcttcgaggtcctcaagcgggccttcggcgtgctgaagatgtaccgcgacctgaccaaccactacaagacctacgaggagaagctcaacgacgggtgcgagttcctgacctccacggagcagcccctgagcggcatgatcaacaactactacaccgtggcgctccggaacatgaacgagcgctacggctacaagaccgaggacctggccttcatccaggacaagcggttcaagttcgtcaaggacgcctacgggaagaagaagtcccaggtgaacaccggcttcttcctgagcctccaggactacaacggggacacgcagaagaagctgcacctgtccggcgtggggatcgccctcctgatctgcctgttcctcgacaagcagtacatcaacatcttcctgagccgcctgccgatcttctccagctacaacgcgcagtccgaggagcggcgcatcatcatccggagcttcggcatcaactccatcaagctccccaaggaccgcatccacagcgagaagtccaacaagagcgtcgccatggacatgctgaacgaggtgaagcggtgccccgacgagctgttcaccaccctctccgccgagaagcagagccgcttccggatcatcagcgacgaccacaacgaggtgctgatgaagcgctccagcgaccggttcgtccccctgctcctgcagtacatcgactacggcaagctgttcgaccacatccgcttccacgtgaacatggggaagctccggtacctgctgaaggccgacaagacctgcatcgacggccagacgcgcgtgcgggtcatcgagcagccgctcaacgggttcggccgcctggaggaggccgagaccatgcgcaagcaggagaacggcaccttcgggaactccggcatccggatccgcgacttcgagaacatgaagcgggacgacgcgaaccccgccaactacccctacatcgtggacacctacacgcactacatcctggagaacaacaaggtggagatgttcatcaacgacaaggaggacagcgcgcccctcctgccggtcatcgaggacgaccgctacgtggtgaagaccatcccctcctgccggatgagcaccctggagatccccgccatggccttccacatgttcctcttcgggtccaagaagaccgagaagctgatcgtcgacgtgcacaaccgctacaagcggctgttccaggccatgcagaaggaggaggtcacggccgagaacatcgccagcttcggcatcgccgagtccgacctcccccagaagatcctggacctgatcagcgggaacgcccacggcaaggacgtggacgcgttcatccgcctcaccgtggacgacatgctgaccgacaccgagcggcgcatcaagcggttcaaggacgaccgcaagtccatccggagcgccgacaacaagatgggcaagcgcgggttcaagcagatctccacgggcaagctggccgacttcctggccaaggacatcgtcctcttccagccgagcgtgaacgacggggagaacaagatcaccggcctgaactaccggatcatgcagtccgccatcgcggtgtacgacagcggggacgactacgaggccaagcagcagttcaagctgatgttcgagaaggcccgcctcatcggcaagggcaccaccgagccccaccccttcctgtacaaggtcttcgcccggtccatccccgcgaacgccgtggagttctacgagcgctacctgatcgagcggaagttctacctcacggggctgagcaacgagatcaagaagggcaaccgcgtggacgtcccgttcatccgccgggaccagaacaagtggaagacccccgccatgaagaccctggggcgcatctactccgaggacctccccgtggagctgccccggcagatgttcgacaacgagatcaagagccacctcaagagcctcccgcagatggagggcatcgacttcaacaacgccaacgtgacctacctgatcgccgagtacatgaagcgcgtcctggacgacgacttccagacgttctaccagtggaaccggaactaccgctacatggacatgctcaagggggagtacgaccggaagggctccctgcagcactgcttcaccagcgtggaggagcgcgagggcctgtggaaggagcgggcgtcccgcaccgagcggtaccgcaagcaggccagcaacaagatccggtccaaccgccagatgcggaacgccagctccgaggagatcgagaccatcctcgacaagcgcctgagcaactcccggaacgagtaccagaagtccgagaaggtgatccgccggtaccgcgtccaggacgccctgctgttcctgctggccaagaagacgctcaccgagctggcggacttcgacggggagcggttcaagctgaaggagatcatgcccgacgccgagaagggcatcctcagcgagatcatgcccatgagcttcaccttcgagaagggcgggaagaagtacaccatcacctccgagggcatgaagctgaagaactacggggacttcttcgtgctggccagcgacaagcgcatcggcaacctcctggagctggtggggtccgacatcgtcagcaaggaggacatcatggaggagttcaacaagtacgaccagtgccgccccgagatctccagcatcgtgttcaacctcgagaagtgggccttcgacacgtacccggagctgagcgcccgggtggaccgcgaggagaaggtcgacttcaagtccatcctgaagatcctcctgaacaacaagaacatcaacaaggagcagagcgacatcctgcggaagatccgcaacgcgttcgaccacaacaactaccccgacaagggcgtggtggagatcaaggccctccccgagatcgccatgtccatcaagaaggccttcggggagtacgcgatcatgaagtga

SEQ ID NO: 11168 - RNA, 4152 nt, synthetic construct
  misc_feature 1..4152: note = Cas13b variant__Artificial____PspCas13b-GS-HsADAR2DD(E488Q,del984- 1090)
  source 1..4152: mol_type = other RNA
atgaacatccccgccctggtggagaaccagaagaagtacttcggcacctacagcgtcatggccatgctcaacgcgcagaccgtgctggaccacatccagaaggtggccgacatcgagggggagcagaacgagaacaacgagaacctgtggttccacccggtcatgtcccacctctacaacgccaagaacggctacgacaagcagcccgagaagacgatgttcatcatcgagcgcctgcagagctacttccccttcctgaagatcatggccgagaaccagcgggagtactccaacgggaagtacaagcagaaccgcgtggaggtgaacagcaacgacatcttcgaggtcctcaagcgggccttcggcgtgctgaagatgtaccgcgacctgaccaacgcgtacaagacctacgaggagaagctcaacgacgggtgcgagttcctgacctccacggagcagcccctgagcggcatgatcaacaactactacaccgtggccctccggaacatgaacgagcgctacggctacaagaccgaggacctggccttcatccaggacaagcggttcaagttcgtcaaggacgcctacgggaagaagaagtcccaggtgaacaccggcttcttcctgagcctccaggactacaacggggacacgcagaagaagctgcacctgtccggcgtggggatcgcgctcctgatctgcctgttcctcgacaagcagtacatcaacatcttcctgagccgcctgccgatcttctccagctacaacgcccagtccgaggagcggcgcatcatcatccggagcttcggcatcaactccatcaagctccccaaggaccgcatccacagcgagaagtccaacaagagcgtcgccatggacatgctgaacgaggtgaagcggtgccccgacgagctgttcaccaccctctccgccgagaagcagagccgcttccggatcatcagcgacgaccacaacgaggtgctgatgaagcgctccagcgaccggttcgtccccctgctcctgcagtacatcgactacggcaagctgttcgaccacatccgcttccacgtgaacatggggaagctccggtacctgctgaaggccgacaagacctgcatcgacggccagacgcgcgtgcgggtcatcgagcagccgctcaacgggttcggccgcctggaggaggcggagaccatgcgcaagcaggagaacggcaccttcgggaactccggcatccggatccgcgacttcgagaacatgaagcgggacgacgccaaccccgccaactacccctacatcgtggacacctacacgcactacatcctggagaacaacaaggtggagatgttcatcaacgacaaggaggacagcgcgcccctcctgccggtcatcgaggacgaccgctacgtggtgaagaccatcccctcctgccggatgagcaccctggagatccccgccatggccttccacatgttcctcttcgggtccaagaagaccgagaagctgatcgtcgacgtgcacaaccgctacaagcggctgttccaggccatgcagaaggaggaggtcacggccgagaacatcgccagcttcggcatcgccgagtccgacctcccccagaagatcctggacctgatcagcgggaacgcgcacggcaaggacgtggacgccttcatccgcctcaccgtggacgacatgctgaccgacaccgagcggcgcatcaagcggttcaaggacgaccgcaagtccatccggagcgccgacaacaagatgggcaagcgcgggttcaagcagatctccacgggcaagctggccgacttcctggccaaggacatcgtcctcttccagccgagcgtgaacgacggggagaacaagatcaccggcctgaactaccggatcatgcagtccgcgatcgccgtgtacgacagcggggacgactacgaggccaagcagcagttcaagctgatgttcgagaaggcccgcctcatcggcaagggcaccaccgagccccaccccttcctgtacaaggtcttcgcgcggtccatccccgccaacgccgtggagttctacgagcgctacctgatcgagcggaagttctacctcacggggctgagcaacgagatcaagaagggcaaccgcgtggacgtcccgttcatccgccgggaccagaacaagtggaagacccccgccatgaagaccctggggcgcatctactccgaggacctccccgtggagctgccccggcagatgttcgacaacgagatcaagagccacctcaagagcctcccgcagatggagggcatcgacttcaacaacgccaacgtgacctacctgatcgcggagtacatgaagcgcgtcctggacgacgacttccagacgttctaccagtggaaccggaactaccgctacatggacatgctcaagggggagtacgaccggaagggctccctgcagcactgcttcaccagcgtggaggagcgcgagggcctgtggaaggagcgggcctcccgcaccgagcggtaccgcaagcaggccagcaacaagatccggtccaaccgccagatgcggaacgccagctccgaggagatcgagaccatcctcgacaagcgcctgagcaactcccggaacgagtaccagaagtccgagaaggtgatccgccggtaccgcgtccaggacgccctgctgttcctgctggcgaagaagacgctcaccgagctggccgacttcgacggggagcggttcaagctgaaggagatcatgcccgacgccgagaagggcatcctcagcgagatcatgcccatgagcttcaccttcgagaagggcgggaagaagtacaccatcacctccgagggcatgaagctgaagaactacggggacttcttcgtgctggccagcgacaagcgcatcggcaacctcctggagctggtggggtccgacatcgtcagcaaggaggacggctccctccagctgcccccgctggagcgcctcacgctggggagccagctgcacctcccccaggtgctggccgacgcggtgagccggctggtcctcggcaagttcggcgacctgaccgacaacttctccagcccccacgcccgccggaaggtgctggccggggtggtcatgaccaccggcacggacgtgaaggacgccaaggtgatctccgtcagcaccgggaccaagtgcatcaacggcgagtacatgtccgaccgcgggctcgcgctgaacgactgccacgccgagatcatcagccggcgctccctgctccggttcctgtacacccagctggagctctacctgaacaacaaggacgaccagaagcgcagcatcttccagaagtccgagcggggcggcttccgcctgaaggagaacgtgcagttccacctctacatcagcacgtccccgtgcggggacgcccggatcttcagcccccacgagcccatcctggaggagcccgccgaccgccacccgaaccggaaggcccgcggccagctgcggaccaagatcgagtccgggcagggcaccatccccgtgcgcagcaacgcgtccatccagacctgggacggggtcctccagggcgagcggctgctgacgatgagctgctccgacaagatcgcccgctggaacgtggtgggcatccaggggagcctcctgtccatcttcgtcgagcccatctacttcagcagcatcatcctgggctccctctaccacggggaccacctgagccgggccatgtaccagcgcatctccaacatcgaggacctgcccccgctctacaccctgaacaagcccctgctcagcggcatctccaacgccgaggcccgccagcccgggaaggcgcccaacttcagcgtgaactggaccgtgggcgactccgccatcgaggtcatcaacgccaccacgggcaaggacgagctggggcgggccagccgcctgtgcaagcacgccctctactgccggtggatgcgcgtgcacggcaaggtgccgtcccacctcctgcggagcaagatcaccaagcccaacgtctaccacgagtccaagctggcggccaaggagtaccaggccgccaaggcgcgcctgttcaccgccttcatcaaggccgggctgggcgcctgggtggagaagcccaccgagcaggaccagttcagcctcacgtga

SEQ ID NO: 11169 - RNA, 4152 nt, synthetic construct
  misc_feature 1..4152: note = Cas13b variant__Artificial____PspCas13b-GS-HsADAR2DD(E488Q,T375G,d el984- 1090)
  source 1..4152: mol_type = other RNA
atgaacatccccgccctggtggagaaccagaagaagtacttcggcacctacagcgtcatggccatgctcaacgcgcagaccgtgctggaccacatccagaaggtggccgacatcgagggggagcagaacgagaacaacgagaacctgtggttccacccggtcatgtcccacctctacaacgccaagaacggctacgacaagcagcccgagaagacgatgttcatcatcgagcgcctgcagagctacttccccttcctgaagatcatggccgagaaccagcgggagtactccaacgggaagtacaagcagaaccgcgtggaggtgaacagcaacgacatcttcgaggtcctcaagcgggccttcggcgtgctgaagatgtaccgcgacctgaccaacgcgtacaagacctacgaggagaagctcaacgacgggtgcgagttcctgacctccacggagcagcccctgagcggcatgatcaacaactactacaccgtggccctccggaacatgaacgagcgctacggctacaagaccgaggacctggccttcatccaggacaagcggttcaagttcgtcaaggacgcctacgggaagaagaagtcccaggtgaacaccggcttcttcctgagcctccaggactacaacggggacacgcagaagaagctgcacctgtccggcgtggggatcgcgctcctgatctgcctgttcctcgacaagcagtacatcaacatcttcctgagccgcctgccgatcttctccagctacaacgcccagtccgaggagcggcgcatcatcatccggagcttcggcatcaactccatcaagctccccaaggaccgcatccacagcgagaagtccaacaagagcgtcgccatggacatgctgaacgaggtgaagcggtgccccgacgagctgttcaccaccctctccgccgagaagcagagccgcttccggatcatcagcgacgaccacaacgaggtgctgatgaagcgctccagcgaccggttcgtccccctgctcctgcagtacatcgactacggcaagctgttcgaccacatccgcttccacgtgaacatggggaagctccggtacctgctgaaggccgacaagacctgcatcgacggccagacgcgcgtgcgggtcatcgagcagccgctcaacgggttcggccgcctggaggaggcggagaccatgcgcaagcaggagaacggcaccttcgggaactccggcatccggatccgcgacttcgagaacatgaagcgggacgacgccaaccccgccaactacccctacatcgtggacacctacacgcactacatcctggagaacaacaaggtggagatgttcatcaacgacaaggaggacagcgcgcccctcctgccggtcatcgaggacgaccgctacgtggtgaagaccatcccctcctgccggatgagcaccctggagatccccgccatggccttccacatgttcctcttcgggtccaagaagaccgagaagctgatcgtcgacgtgcacaaccgctacaagcggctgttccaggccatgcagaaggaggaggtcacggccgagaacatcgccagcttcggcatcgccgagtccgacctcccccagaagatcctggacctgatcagcgggaacgcgcacggcaaggacgtggacgccttcatccgcctcaccgtggacgacatgctgaccgacaccgagcggcgcatcaagcggttcaaggacgaccgcaagtccatccggagcgccgacaacaagatgggcaagcgcgggttcaagcagatctccacgggcaagctggccgacttcctggccaaggacatcgtcctcttccagccgagcgtgaacgacggggagaacaagatcaccggcctgaactaccggatcatgcagtccgcgatcgccgtgtacgacagcggggacgactacgaggccaagcagcagttcaagctgatgttcgagaaggcccgcctcatcggcaagggcaccaccgagccccaccccttcctgtacaaggtcttcgcgcggtccatccccgccaacgccgtggagttctacgagcgctacctgatcgagcggaagttctacctcacggggctgagcaacgagatcaagaagggcaaccgcgtggacgtcccgttcatccgccgggaccagaacaagtggaagacccccgccatgaagaccctggggcgcatctactccgaggacctccccgtggagctgccccggcagatgttcgacaacgagatcaagagccacctcaagagcctcccgcagatggagggcatcgacttcaacaacgccaacgtgacctacctgatcgcggagtacatgaagcgcgtcctggacgacgacttccagacgttctaccagtggaaccggaactaccgctacatggacatgctcaagggggagtacgaccggaagggctccctgcagcactgcttcaccagcgtggaggagcgcgagggcctgtggaaggagcgggcctcccgcaccgagcggtaccgcaagcaggccagcaacaagatccggtccaaccgccagatgcggaacgccagctccgaggagatcgagaccatcctcgacaagcgcctgagcaactcccggaacgagtaccagaagtccgagaaggtgatccgccggtaccgcgtccaggacgccctgctgttcctgctggcgaagaagacgctcaccgagctggccgacttcgacggggagcggttcaagctgaaggagatcatgcccgacgccgagaagggcatcctcagcgagatcatgcccatgagcttcaccttcgagaagggcgggaagaagtacaccatcacctccgagggcatgaagctgaagaactacggggacttcttcgtgctggccagcgacaagcgcatcggcaacctcctggagctggtggggtccgacatcgtcagcaaggaggacggctccctccagctgcccccgctggagcgcctcacgctggggagccagctgcacctcccccaggtgctggccgacgcggtgagccggctggtcctcggcaagttcggcgacctgaccgacaacttctccagcccccacgcccgccggaaggtgctggccggggtggtcatgaccaccggcacggacgtgaaggacgccaaggtgatctccgtcagcaccgggggcaagtgcatcaacggggagtacatgtccgaccgcggcctcgcgctgaacgactgccacgccgagatcatcagccggcgctccctgctccggttcctgtacacccagctggagctctacctgaacaacaaggacgaccagaagcgcagcatcttccagaagtccgagcggggcgggttccgcctgaaggagaacgtgcagttccacctctacatcagcacctccccgtgcggcgacgcccggatcttcagcccccacgagcccatcctggaggagcccgccgaccgccacccgaaccggaaggcccgcgggcagctgcggacgaagatcgagtccggccaggggaccatccccgtgcgcagcaacgcgtccatccagacctgggacggcgtcctccagggcgagcggctgctgaccatgagctgctccgacaagatcgcccgctggaacgtggtggggatccagggcagcctcctgtccatcttcgtcgagcccatctacttcagcagcatcatcctggggtccctctaccacggcgaccacctgagccgggccatgtaccagcgcatctccaacatcgaggacctgcccccgctctacacgctgaacaagcccctgctcagcgggatctccaacgccgaggcccgccagcccggcaaggcgcccaacttcagcgtgaactggaccgtgggcgactccgccatcgaggtcatcaacgccaccaccgggaaggacgagctgggccgggccagccgcctgtgcaagcacgccctctactgccggtggatgcgcgtgcacgggaaggtgccgtcccacctcctgcggagcaagatcacgaagcccaacgtctaccacgagtccaagctggcggccaaggagtaccaggccgccaaggcgcgcctgttcaccgccttcatcaaggccggcctgggcgcctgggtggagaagcccaccgagcaggaccagttcagcctcacctga

SEQ ID NO: 11170 - RNA, 2862 nt, synthetic construct
  misc_feature 1..2862: note = Cas13b variant__Alistipes sp.__WP_047447901.1__Cas13b
  source 1..2862: mol_type = other RNA
atgagcaacgagatcggcgccttccgcgagcaccagttcgcctacgcgcccgggaacgagaagcaggaggaggccaccttcgccacctacttcaacctggccctctccaacgtggagggcatgatgttcggggaggtcgagagcaacccggacaagatcgagaagtccctggacacgctgccgcccgccatcctccggcagatcgcgagcttcatctggctgtccaaggaggaccaccccgacaaggcctacagcaccgaggaggtgaaggtgatcgtcaccgacctggtgcgccggctctgcttctaccgcaactacttctcccactgcttctacctggacacccagtacttctacagcgacgagctggtggacacgaccgccatcggcgagaagctcccctacaacttccaccacttcatcaccaaccggctgttccgctactccctgcccgagatcaccctcttccggtggaacgagggggagcgcaagtacgagatcctgcgggacggcctgatcttcttctgctgcctcttcctgaagcgcggccaggccgagcggttcctgaacgagctccgcttcttcaagcggacggacgaggaggggcgcatcaagcggaccatcttcaccaagtactgcacccgcgagagccacaagcacatcggcatcgaggagcaggacttcctgatcttccaggacatcatcggggacctgaaccgggtccccaaggtgtgcgacggcgtggtcgacctctccaaggagaacgagcgctacatcaagaaccgggagacgagcaacgagtccgacgagaacaaggcgcgctaccggctgctgatccgcgagaaggacaagttcccctactacctcatgcgctacatcgtggacttcggggtgctgccgtgcatcaccttcaagcagaacgactacagcaccaaggagggccggggccagttccactaccaggacgccgccgtcgcccaggaggagcgctgctacaacttcgtggtgcggaacgggaacgtctactactcctacatgccccaggcccagaacgtggtgcgcatcagcgagctgcagggcaccatctccgtcgaggagctccggaacatggtgtacgcgagcatcaacgggaaggacgtgaacaagtccgtcgagcagtacctgtaccacctccacctcctgtacgagaagatcctgacgatcagcggccagaccatcaaggagggccgcgtggacgtggaggactaccggcccctgctggacaagctgctcctgcgccccgccagcaacggggaggagctgcggcgcgagctccggaagctgctgccgaagcgcgtctgcgacctcctgtccaaccggttcgactgcagcgagggcgtgtccgccgtcgagaagcgcctgaaggccatcctcctgcggcacgagcagctgctcctgagccagaaccccgccctgcacatcgacaagatcaagtccgtgatcgactacctgtacctcttcttcagcgacgacgagaagttccgccagcagcccaccgagaaggcgcaccgggggctgaaggacgaggagttccagatgtaccactacctggtgggcgactacgactcccaccccctcgccctgtggaaggagctggaggccagcgggcgcctcaagccggagatgcggaagctgacctccgccacgagcctgcacggcctctacatgctgtgcctgaagggcaccgtcgagtggtgccgcaagcagctcatgtccatcgggaagggcaccgccaaggtggaggcgatcgccgaccgcgtggggctgaagctgtacgacaagctcaaggagtacacccccgagcagctggagcgggaggtcaagctggtggtgatgcacggctacgccgccgccgcgacgcccaagcccaaggcccaggccgccatcccgagcaagctcaccgagctgcgcttctactccttcctggggaagcgggagatgagcttcgcggccttcatccgccaggacaagaaggcccagaagctctggctgcggaacttctacaccgtcgagaacatcaagaccctgcagaagcgccaggccgccgcggacgccgcctgcaagaagctctacaacctggtgggcgaggtggagcgggtccacacgaacgacaaggtgctggtgctcgtcgcccagcgctaccgggagcgcctgctgaacgtgggctccaagtgcgccgtgaccctcgacaaccccgagcggcagcagaagctggcggacgtctacgaggtgcagaacgcctggctgagcatccgcttcgacgacctcgacttcaccctgacccacgtgaacctgtccaacctccggaaggcctacaacctgatcccccgcaagcacatcctggccttcaaggagtacctcgacaaccgggtcaagcagaagctgtgcgaggagtgccgcaacgtgcggcgcaaggaggacctgtgcacgtgctgcagcccccggtactccaacctcaccagctggctgaaggagaaccacagcgagtccagcatcgagcgcgaggccgcgaccatgatgctgctcgacgtggagcggaagctgctgtccttcctcctggacgagcgccgcaaggccatcatcgagtacgggaagttcatcccgttcagcgccctggtcaaggagtgccggctcgccgacgcgggcctgtgcgggatccgcaacgacgtgctgcacgacaacgtgatctcctacgccgacgccatcggcaagctcagcgcctacttccccaaggaggcctccgaggcggtcgagtacatccggcgcaccaaggaggtgcgggagcagcgccgggaggagctgatggccaacagctcccagtga

SEQ ID NO: 11171 - RNA, 3348 nt, synthetic construct
  misc_feature 1..3348: note = Cas13b variant__Bacteroides pyogenes__ERI81700.1__Cas13b
  source 1..3348: mol_type = other RNA
atggagagcatcaagaactcccagaagtccaccggcaagaccctgcagaaggacccgccctacttcgggctctacctgaacatggccctgctcaacgtgcgcaaggtcgagaaccacatccggaagtggctgggcgacgtggccctgctccccgagaagtccgggttccacagcctgctgacgaccgacaacctcagcagcgcgaagtggacccgcttctactacaagtcccggaagttcctgcccttcctggagatgttcgacagcgacaagaagtcctacgagaaccgccgggagaccacggagtgcctcgacaccatcgaccgccagaagatcagctccctgctgaaggaggtgtacggcaagctccaggacatccggaacgccttcagccactaccacatcgacgaccagtccgtcaagcacaccgccctgatcatcagctccgagatgcaccgcttcatcgagaacgcctacagcttcgccctgcagaagacccgggcgcgcttcacgggggtgttcgtggagaccgacttcctccaggccgaggagaagggcgacaacaagaagttcttcgccatcggcgggaacgagggcatcaagctgaaggacaacgccctgatcttcctcatctgcctgttcctggaccgggaggaggcgttcaagttcctctcccgcgccaccgggttcaagagcaccaaggagaagggcttcctggccgtccgggagacgttctgcgccctgtgctgccgccagccccacgagcggctcctgtccgtgaacccgcgcgaggccctgctcatggacatgctgaacgagctgaaccggtgccccgacatcctcttcgagatgctggacgagaaggaccagaagtccttcctgcccctcctgggggaggaggagcaggcgcacatcctggagaacagcctcaacgacgagctgtgcgaggccatcgacgaccccttcgagatgatcgccagcctgagcaagcgcgtgcggtacaagaaccgcttcccgtacctcatgctgcggtacatcgaggagaagaacctgctccccttcatccgcttccgcatcgacctgggctgcctggagctcgcctcctaccccaagaagatgggcgaggagaacaactacgagcggagcgtcaccgaccacgccatggcgttcgggcgcctgaccgacttccacaacgaggacgccgtgctgcagcagatcaccaagggcatcacggacgaggtgcggttctccctgtacgcgccccgctacgccatctacaacaacaagatcgggttcgtccggaccggcggcagcgacaagatctccttcccgaccctcaagaagaagggcggggaggggcactgcgtggcctacaccctgcagaacaccaagagcttcggcttcatctccatctacgacctgcgcaagatcctcctgctgagcttcctcgacaaggacaaggccaagaacatcgtgtccgggctgctggagcagtgcgagaagcactggaaggacctcagcgagaacctgttcgacgccatccggacggagctgcagaaggagttccccgtccccctcatccgctacaccctgccccggtccaagggcggcaagctggtgagctccaagctcgccgacaagcaggagaagtacgagagcgagttcgagcgccggaaggagaagctgaccgagatcctgtccgagaaggacttcgacctcagccagatcccgcgccggatgatcgacgagtggctgaacgtgctgcccacgtcccgcgagaagaagctcaaggggtacgtcgagaccctgaagctggactgccgggagcgcctccgggtgttcgagaagcgcgagaagggcgagcaccccgtgcccccgcggatcggggagatggccaccgacctggccaaggacatcatccgcatggtcatcgaccagggcgtgaagcagcgcatcaccagcgcgtactacagcgagatccagcggtgcctggcccagtacgccggggacgacaaccgccggcacctcgactccatcatccgcgagctgcggctgaaggacacgaagaacggccaccccttcctcggcaaggtgctgcgccccgggctgggccacaccgagaagctctaccagcggtacttcgaggagaagaaggagtggctggaggccaccttctaccccgcggccagcccgaagcgcgtcccccggttcgtgaacccgcccaccgggaagcagaaggagctgcccctcatcatccgcaacctgatgaaggagcggcccgagtggcgcgactggaagcagcggaagaactcccaccccatcgacctgccgagccagctgttcgagaacgagatctgccgcctcctgaaggacaagatcggcaaggagccctccgggaagctcaagtggaacgagatgttcaagctgtactgggacaaggagttccccaacggcatgcagcggttctaccgctgcaagcggcgcgtcgaggtgttcgacaaggtggtcgagtacgagtacagcgaggagggcgggaactacaagaagtactacgaggccctgatcgacgaggtggtgcggcagaagatctccagctccaaggagaagtccaagctccaggtcgaggacctgacgctgagcgtgcgccgggtgttcaagcgcgccatcaacgagaaggagtaccagctccgcctgctgtgcgaggacgaccggctcctgttcatggccgtccgcgacctgtacgactggaaggaggcgcagctcgacctggacaagatcgacaacatgctgggcgagcccgtgagcgtgtcccaggtcatccagctcgagggcgggcagccggacgccgtgatcaaggccgagtgcaagctgaaggacgtgagcaagctgatgcggtactgctacgacggccgcgtcaaggggctcatgccctacttcgccaaccacgaggccacccaggagcaggtcgagatggagctgcggcactacgaggaccaccgccggcgcgtgttcaactgggtgttcgcgctggagaagtccgtgctcaagaacgagaagctgcggcgcttctacgaggagagccagggcgggtgcgagcaccggcgctgcatcgacgccctgcggaaggcctccctcgtgagcgaggaggagtacgagttcctggtccacatccgcaacaagagcgcccacaaccagttccccgacctggagatcggcaagctgcccccgaacgtgacctccgggttctgcgagtgcatctggagcaagtacaaggccatcatctgccggatcatccccttcatcgaccccgagcgccggttcttcggcaagctcctggagcagaagtga

SEQ ID NO: 11172 - RNA, 3348 nt, synthetic construct
  misc_feature 1..3348: note = Cas13b variant__Bacteroides pyogenes__WP_034542281.1__Cas13b
  source 1..3348: mol_type = other RNA
atggagagcatcaagaactcccagaagtccaccggcaagaccctgcagaaggacccgccctacttcgggctctacctgaacatggccctgctcaacgtgcgcaaggtcgagaaccacatccggaagtggctgggcgacgtggccctgctccccgagaagtccgggttccacagcctgctgacgaccgacaacctcagcagcgcgaagtggacccgcttctactacaagtcccggaagttcctgcccttcctggagatgttcgacagcgacaagaagtcctacgagaaccgccgggagaccgccgagtgcctcgacacgatcgaccgccagaagatcagctccctgctgaaggaggtgtacggcaagctccaggacatccggaacgccttcagccactaccacatcgacgaccagtccgtcaagcacaccgccctgatcatcagctccgagatgcaccgcttcatcgagaacgcctacagcttcgcgctgcagaagacccgggcccgcttcaccggggtgttcgtggagacggacttcctccaggccgaggagaagggcgacaacaagaagttcttcgccatcggcgggaacgagggcatcaagctgaaggacaacgcgctgatcttcctcatctgcctgttcctggaccgggaggaggccttcaagttcctctcccgcgccaccgggttcaagagcaccaaggagaagggcttcctggccgtccgggagaccttctgcgccctgtgctgccgccagccccacgagcggctcctgtccgtgaacccgcgcgaggcgctgctcatggacatgctgaacgagctgaaccggtgccccgacatcctcttcgagatgctggacgagaaggaccagaagtccttcctgcccctcctgggggaggaggagcaggcccacatcctggagaacagcctcaacgacgagctgtgcgaggccatcgacgaccccttcgagatgatcgccagcctgagcaagcgcgtgcggtacaagaaccgcttcccgtacctcatgctgcggtacatcgaggagaagaacctgctccccttcatccgcttccgcatcgacctgggctgcctggagctcgcctcctaccccaagaagatgggcgaggagaacaactacgagcggagcgtcacggaccacgcgatggccttcgggcgcctgaccgacttccacaacgaggacgccgtgctgcagcagatcaccaagggcatcaccgacgaggtgcggttctccctgtacgcgccccgctacgccatctacaacaacaagatcgggttcgtccggacgagcggctccgacaagatcagcttcccgaccctcaagaagaagggcggggagggccactgcgtggcctacaccctgcagaacaccaagtccttcgggttcatcagcatctacgacctgcgcaagatcctcctgctgtccttcctcgacaaggacaaggccaagaacatcgtgagcggcctgctggagcagtgcgagaagcactggaaggacctctccgagaacctgttcgacgccatccggacggagctgcagaaggagttccccgtccccctcatccgctacaccctgccccggagcaagggcgggaagctggtgtccagcaagctcgccgacaagcaggagaagtacgagtccgagttcgagcgccggaaggagaagctgaccgagatcctgagcgagaaggacttcgacctctcccagatcccgcgccggatgatcgacgagtggctgaacgtgctgcccaccagccgcgagaagaagctcaagggctacgtcgagacgctgaagctggactgccgggagcgcctccgggtgttcgagaagcgcgagaagggggagcaccccctgcccccgcggatcggcgagatggccaccgacctggcgaaggacatcatccgcatggtgatcgaccagggggtcaagcagcgcatcaccagcgcctactactccgagatccagcggtgcctcgcccagtacgccggcgacgacaaccgccggcacctggacagcatcatccgcgagctgcggctcaaggacaccaagaacgggcaccccttcctgggcaaggtgctgcgccccggcctcgggcacacggagaagctgtaccagcggtacttcgaggagaagaaggagtggctggaggcgaccttctaccccgccgcctccccgaagcgcgtgccccggttcgtcaacccgcccaccggcaagcagaaggagctccccctgatcatccgcaacctgatgaaggagcggcccgagtggcgcgactggaagcagcggaagaacagccaccccatcgacctcccgtcccagctgttcgagaacgagatctgccgcctgctcaaggacaagatcgggaaggagcccagcggcaagctgaagtggaacgagatgttcaagctgtactgggacaaggagttccccaacgggatgcagcggttctaccgctgcaagcggcgcgtggaggtcttcgacaaggtggtggagtacgagtactccgaggagggcggcaactacaagaagtactacgaggccctcatcgacgaggtcgtgcggcagaagatcagctccagcaaggagaagtccaagctccaggtggaggacctgaccctgagcgtccgccgggtgttcaagcgcgccatcaacgagaaggagtaccagctgcgcctgctctgcgaggacgaccggctgctgttcatggcggtgcgcgacctctacgactggaaggaggcccagctggacctggacaagatcgacaacatgctcggggagcccgtctccgtgagccaggtgatccagctggagggcgggcagccggacgccgtcatcaaggccgagtgcaagctgaaggacgtgtccaagctcatgcggtactgctacgacggccgcgtgaagggcctgatgccctacttcgccaaccacgaggcgacgcaggagcaggtcgagatggagctgcggcactacgaggaccaccgccggcgcgtgttcaactgggtgttcgccctcgagaagtccgtcctgaagaacgagaagctgcggcgcttctacgaggagagccagggcgggtgcgagcaccggcgctgcatcgacgccctccggaaggccagcctggtgagcgaggaggagtacgagttcctggtgcacatccgcaacaagtccgcccacaaccagttccccgacctcgagatcgggaagctgcccccgaacgtcaccagcggcttctgcgagtgcatctggtccaagtacaaggcgatcatctgccggatcatccccttcatcgaccccgagcgccggttcttcgggaagctgctcgagcagaagtga

SEQ ID NO: 11173 - RNA, 3675 nt, synthetic construct; identical to SEQ ID NO: 11164
  misc_feature 1..3675: note = Cas13b variant__Bergeyella zoohelcum__WP_002664492.1__Cas13b
  source 1..3675: mol_type = other RNA

SEQ ID NO: 11174 - RNA, 3600 nt, synthetic construct
  misc_feature 1..3600: note = Cas13b variant__Capnocytophaga canimorsus__WP_013997271.1__Cas13b
  source 1..3600: mol_type = other RNA
atgaagaacatccagcgcctgggcaaggggaacgagttcagccccttcaagaaggaggacaagttctacttcggcgggttcctcaacctggccaacaacaacatcgaggacttcttcaaggagatcatcacccggttcggcatcgtgatcaccgacgagaacaagaagccgaaggagacgttcggggagaagatcctgaacgagatcttcaagaaggacatctccatcgtcgactacgagaagtgggtgaacatcttcgccgactacttccccttcaccaagtacctcagcctgtacctggaggagatgcagttcaagaaccgcgtgatctgcttccgggacgtcatgaaggagctcctgaagaccgtggaggcgctgcgcaacttctacacccactacgaccacgagcccatcaagatcgaggaccgggtgttctacttcctcgacaaggtcctgctggacgtgtccctcacggtgaagaacaagtacctgaagaccgacaagaccaaggagttcctgaaccagcacatcggcgaggagctcaaggagctgtgcaagcagcgcaaggactacctggtcggcaaggggaagcggatcgacaaggagagcgagatcatcaacggcatctacaacaacgccttcaaggacttcatctgcaagcgcgagaagcaggacgacaaggagaaccacaactccgtggagaagatcctctgcaacaaggagccccagaacaagaagcagaagtccagcgccaccgtgtgggagctgtgcagcaagtccagctccaagtacacggagaagtccttcccgaaccgggagaacgacaagcactgcctggaggtccccatcagccagaaggggatcgtgttcctcctgagcttcttcctgaacaagggcgagatctacgccctcacctccaacatcaaggggttcaaggccaagatcaccaaggaggagcccgtgacctacgacaagaacagcatccgctacatggcgacgcaccggatgttctccttcctggcctacaagggcctgaagcgcaagatccggaccagcgagatcaactacaacgaggacggccaggcctccagcacctacgagaaggagaccctcatgctgcagatgctggacgagctcaacaaggtccccgacgtggtgtaccagaacctgagcgaggacgtccagaagacgttcatcgaggactggaacgagtacctgaaggagaacaacggggacgtgggcaccatggaggaggagcaggtcatccacccggtgatccgcaagcggtacgaggacaagttcaactacttcgccatccgcttcctcgacgagttcgcgcagttccccaccctgcggttccaggtgcacctggggaactacctctgcgacaagcgcaccaagcagatctgcgacacgaccaccgagcgggaggtgaagaagaagatcaccgtcttcggccgcctgtccgagctggagaacaagaaggccatcttcctcaacgagcgggaggagatcaagggctgggaggtgttccccaaccccagctacgacttcccgaaggagaacatctccgtcaactacaaggacttccccatcgtggggagcatcctggaccgcgagaagcagcccgtgtccaacaagatcggcatccgcgtcaagatcgccgacgagctgcagcgggagatcgacaaggccatcaaggagaagaagctccgcaaccccaagaaccggaaggccaaccaggacgagaagcagaaggagcgcctggtgaacgagatcgtgagcacgaactccaacgagcagggggagccggtcgtgttcatcggccagcccaccgcgtacctgagcatgaacgacatccactccgtgctctacgagttcctgatcaacaagatcagcggggaggccctggagaccaagatcgtcgagaagatcgagacccagatcaagcagatcatcggcaaggacgccacgaccaagatcctcaagccctacaccaacgccaactccaacagcatcaaccgggagaagctgctgcgcgacctggagcaggagcagcagatcctcaagaccctgctggaggagcagcagcagcgggagaaggacaagaaggacaagaagtccaagcgcaagcacgagctctaccccagcgagaagggcaaggtggccgtgtggctggcgaacgacatcaagcggttcatgccgaaggccttcaaggagcagtggcgcgggtaccaccactccctgctccagaagtacctggcctactacgagcagagcaaggaggagctgaagaacctcctgcccaaggaggtcttcaagcacttccccttcaagctgaagggctacttccagcagcagtacctcaaccagttctacacggactacctgaagcggcgcctgtcctacgtgaacgagctcctgctgaacatccagaacttcaagaacgacaaggacgccctcaaggccaccgagaaggagtgcttcaagttcttccggaagcagaactacatcatcaaccccatcaacatccagatccagagcatcctggtgtacccgatcttcctgaagcgcgggttcctcgacgagaagcccaccatgatcgaccgggagaagttcaaggagaacaaggacaccgagctggcggactggttcatgcactacaagaactacaaggaggacaactaccagaagttctacgcctaccccctggagaaggtcgaggagaaggagaagttcaagcgcaacaagcagatcaacaagcagaagaagaacgacgtgtacacgctcatgatggtggagtacatcatccagaagatcttcggcgacaagttcgtcgaggagaaccccctggtgctgaaggggatcttccagtccaaggccgagcggcagcagaacaacacccacgccgccaccacccaggagcgcaacctcaacggcatcctgaaccagccgaaggacatcaagatccagggcaagatcaccgtgaagggggtcaagctgaaggacatcggcaacttccggaagtacgagatcgaccagcgcgtgaacacgttcctcgactacgagccccgcaaggagtggatggcgtacctgcccaacgactggaaggagaaggagaagcaggggcagctgccgcccaacaacgtgatcgaccggcagatcagcaagtacgagaccgtccgcagcaagatcctcctgaaggacgtgcaggagctggagaagatcatctccgacgagatcaaggaggagcaccggcacgacctcaagcagggcaagtactacaacttcaagtactacatcctgaacgggctgctccgccagctgaagaacgagaacgtggagaactacaaggtcttcaagctgaacaccaaccccgagaaggtgaacatcacccagctcaagcaggaggccacggacctggagcagaaggccttcgtgctgacctacatccggaacaagttcgcccacaaccagctccccaagaaggagttctgggactactgccaggagaagtacggcaagatcgagaaggagaagacctacgcggagtacttcgccgaggtcttcaagcgcgagaaggaggccctgatcaagtga

SEQ ID NO: 11175 - RNA, 3657 nt, synthetic construct
  misc_feature 1..3657: note = Cas13b variant__Capnocytophaga cynodegmi__WP_041989581.1__Cas13b
  source 1..3657: mol_type = other RNA
atggagaacaagaccagcctgggcaacaacatctactacaaccccttcaagccgcaggacaagtcctacttcgccgggtacctcaacgccgcgatggagaacatcgacagcgtgttccgcgagctgggcaagcggctgaaggggaaggagtacacctccgagaacttcttcgacgccatcttcaaggagaacatcagcctcgtcgagtacgagcgctacgtgaagctgctgtccgactacttccccatggcccggctcctggacaagaaggaggtgcccatcaaggagcgcaaggagaacttcaagaagaacttccggggcatcatcaaggccgtccgcgacctgcggaacttctacacgcacaaggagcacggggaggtggagatcaccgacgagatcttcggcgtgctcgacgagatgctcaagagcaccgtcctgaccgtgaagaagaagaagatcaagacggacaagaccaaggagatcctgaagaagtccatcgagaagcagctggacatcctgtgccagaagaagctcgagtacctgaaggacaccgcccgcaagatcgaggagaagcggcgcaaccagcgggagcgcggcgagaagaagctggtgccccggttcgagtacagcgaccgccgggacgacctcatcgcggccatctacaacgacgccttcgacgtctacatcgacaagaagaaggactccctgaaggagagctccaagaccaagtacaacacggagagctacccgcagcaggaggagggggacctgaagatccccatctccaagaacggcgtggtgttcctcctgagcctgttcctctccaagcaggaggtccacgccttcaagagcaagatcgcggggttcaaggccaccgtgatcgacgaggccaccgtgtcccaccgcaagaacagcatctgcttcatggccacccacgagatcttctcccacctggcctacaagaagctgaagcggaaggtccgcacggcggagatcaactacagcgaggccgagaacgccgagcagctcagcatctacgccaaggagaccctgatgatgcagatgctggacgagctctccaaggtgcccgacgtggtctaccagaacctgagcgaggacgtgcagaagaccttcatcgaggactggaacgagtacctgaaggagaacaacggcgacgtggggaccatggaggaggagcaggtcatccaccccgtgatccggaagcgctacgaggacaagttcaactacttcgccatccggttcctcgacgagttcgcgcagttcccgacgctgcgcttccaggtgcacctgggcaactacctccacgactcccgccccaaggagcacctgatcagcgaccggcgcatcaaggagaagatcaccgtcttcggccggctgtccgagctcgagcacaagaaggccctgttcatcaagaacaccgagaccaacgaggaccgcaagcactactgggaggtgttccccaaccccaactacgacttcccgaaggagaacatcagcgtcaacgacaaggacttccccatcgccgggtccatcctggaccgggagaagcagcccacggccggcaagatcgggatcaaggtgaacctcctgaaccagaagtacatcagcgaggtggacaaggccgtcaaggcgcaccagctgaagcagcgcaacaacaagccctccatccagaacatcatcgaggagatcgtgccgatcaacggcagcaaccccaaggagatcatcgtgttcggcgggcagcccaccgcctacctctccatgaacgacatccacagcatcctgtacgagttcttcgacaagtgggagaagaagaaggagaagctggagaagaagggcgagaaggagctccggaaggagatcgggaaggagctggaggagaagatcgtcggcaagatccagacccagatccagcagatcatcgacaaggacatcaacgccaagatcctgaagccctaccaggacgacgactccaccgccatcgacaaggagaagctgatcaaggacctcaagcaggagcagaagatcctgcagaagctgaagaacgagcagacggcccgcgagaaggagtaccaggagtgcatcgcgtaccaggaggagagccggaagatcaagcgctccgacaagagccggcagaagtacctccgcaaccagctgaagcggaagtacccggaggtgcccacccgcaaggagatcctgtactaccaggagaaggggaaggtggccgtctggctcgccaacgacatcaagcggttcatgcccaccgacttcaagaacgagtggaagggcgagcagcactccctgctgcagaagtccctcgcctactacgagcagtgcaaggaggagctgaagaacctgctcccccagcagaaggtgttcaagcacctcccgttcgagctgggcgggcacttccagcagaagtacctgtaccagttctacacccgctacctggacaagcggctggagcacatcagcggcctcgtgcagcaggcggagaacttcaagaacgagaacaaggtcttcaagaaggtggagaacgagtgcttcaagttcctgaagaagcagaactacacgcacaaggggctggacgcccaggcccagagcgtgctcggctaccccatcttcctggagcgcgggttcatggacgagaagcccaccatcatcaagggcaagaccttcaagggcaacgagagcctgttcaccgactggttccggtactacaaggagtaccagaacttccagacgttctacgacaccgagaactaccccctcgtcgagctggagaagaagcaggccgaccgcaagcgcgagaccaagatctaccagcagaagaagaacgacgtgttcaccctgctcatggccaagcacatcttcaagtccgtgttcaagcaggacagcatcgaccggttctccctggaggacctgtaccagagccgcgaggagcggctcgagaaccaggagaaggcgaagcagacgggggagcgcaacaccaactacatctggaacaagaccgtcgacctgaacctgtgcgacggcaaggtgaccgtggagaacgtcaagctcaagaacgtggggaacttcatcaagtacgagtacgaccagcgggtgcagaccttcctgaagtacgaggagaacatcaagtggcaggccttcctgatcaaggagtccaaggaggaggagaactacccgtacatcgtcgagcgcgagatcgagcagtacgagaaggtgcggcgcgaggagctcctgaaggaggtgcacctgatcgaggagtacatcctcgagaaggtcaaggacaaggagatcctgaagaagggcgacaaccagaacttcaagtactacatcctgaacgggctcctgaagcagctgaagaacgaggacgtggagagctacaaggtgttcaacctcaacacgaagcccgaggacgtcaacatcaaccagctgaagcaggaggccaccgacctggagcagaaggccttcgtgctcacctacatccggaacaagttcgcccacaaccagctgcccaagaaggagttctgggactactgccaggagaagtacggcaagatcgagaaggagaagacctacgcggagtacttcgccgaggtgttcaagcgcgagaaggaggccctgatgaagtga

SEQ ID NO: 11176 - RNA, 3438 nt, synthetic construct
  misc_feature 1..3438: note = Cas13b variant__Chryseobacterium sp.__WP_047431796.1__Cas13b
  source 1..3438: mol_type = other RNA
atggagacccagaccatcggccacgggatcgcctacgaccacagcaagatccaggacaagcacttcttcggcgggttcctgaacctcgccgagaacaacatcaaggcggtgctgaaggccttctccgagaagttcaacgtcggcaacgtggacgtgaagcagttcgccgacgtcagcctgaaggacaacctccccgacaacgacttccagaagcgcgtgtccttcctgaagatgtacttcccggtggtcgacttcatcaacatccccaacaaccgggccaagttccgcagcgacctgacgaccctcttcaagtccgtggaccagctgcggaacttctacacccactactaccacaagcccctggacttcgacgccagcctcttcatcctgctggacgacatcttcgcgcgcaccgccaaggaggtgcgggaccagaagatgaaggacgacaagacgcgccagctcctgtccaagagcctgtccgaggagctccagaaggggtacgagctgcagctggagcggctcaaggagctgaaccgcctgggcaagaaggtcaacatccacgaccagctcggcatcaagaacggggtgctgaacaacgccttcaaccacctgatctacaaggacggcgagagcttcaagaccaagctcacctactccagcgccctgacctccttcgagagcgcggagaacgggatcgagatctcccagagcggcctgctgttcctgctgtccatgttcctcaagcggaaggagatcgaggacctgaagaaccgcaacaaggggttcaaggccaaggtggtcatcgacgaggacggcaaggtgaacggcctgaagttcatggccacgcactgggtgttcagctacctctgcttcaaggggctgaagtccaagctgagcaccgagttccacgaggagaccctcctgatccagatcatcgacgagctgagcaaggtccccgacgagctctactgcgccttcgacaaggagacccgggacaagttcatcgaggacatcaacgagtacgtgaaggagggccaccaggacttctccctggaggacgccaaggtgatccacccggtcatccgcaagcggtacgagaacaagttcaactacttcgcgatccgcttcctggacgagttcgtgaagttccccagcctccggttccaggtgcacgtcgggaactacgtgcacgaccgccggatcaagaacatcgacggcacgaccttcgagaccgagcgcgtggtcaaggaccggatcaaggtgttcggccgcctgtccgagatcagctcctacaaggcccagtacctgagctccgtcagcgacaagcacgacgagaccgggtgggagatcttccccaacccctcctacgtgttcatcaacaacaacatcccgatccacatcagcgtggacacgtccttcaagaaggagatcgccgacttcaagaagctccggcgcgcccaggtccccgacgagctgaagatccgcggcgccgagaagaagcggaagttcgagatcacccagatgatcgggagcaagtccgtgctgaaccaggaggagcccatcgcgctcctgagcctgaacgagatccccgccctgctctacgagatcctgatcaacggcaaggagccggccgagatcgagcgcatcatcaaggacaagctgaacgagcggcaggacgtgatcaagaactacaaccccgagaactggctccccgcctcccagatcagccgccggctgcgctccaacaagggggagcggatcatcaacaccgacaagctgctccagctggtcaccaaggagctgctcgtgacggagcagaagctgaagatcatcagcgacaaccgcgaggccctgaagcagaagaaggagggcaagtacatccggaagttcatcttcaccaactccgagctcggccgcgaggcgatctggctggccgacgacatcaagcggttcatgcccgccgacgtgcgcaaggagtggaaggggtaccagcacagccagctgcagcagagcctcgccttctacaactcccggccgaaggaggccctggcgatcctggagagctcctggaacctcaaggacgagaagatcatctggaacgagtggatcctcaagagcttcacccagaacaagttcttcgacgccttctacaacgagtacctgaagggccgcaagaagtacttcgccttcctctccgagcacatcgtccagtacaccagcaacgccaagaacctgcagaagttcatcaagcagcagatgcccaaggacctgttcgagaagcggcactacatcatcgaggacctccagacggagaagaacaagatcctgtccaagcccttcatcttcccccgcgggatcttcgacaagaagccgaccttcatcaagggcgtgaaggtggaggacagccccgagtccttcgcgaactggtaccagtacgggtaccagaaggaccaccagttccagaagttctacgactggaagcgggactacagcgacgtcttcctggagcacctcggcaagcccttcatcaacaacggcgaccgccggaccctggggatggaggagctgaaggagcgcatcatcatcaagcaggacctcaagatcaagaagatcaagatccaggacctgttcctgcgcctcatcgccgagaacctgttccagaaggtgttcaagtactccgccaagctgcccctcagcgacttctacctgacccaggaggagcggatggagaaggagaacatggccgccctgcagaacgtgcgcgaggagggcgacaagtccccgaacatcatcaaggacaacttcatctggagcaagatgatcccctacaagaaggggcagatcatcgagaacgcggtcaagctcaaggacatcggcaagctgaacgtgctgtccctcgacgacaaggtgcagacgctgctgagctacgacgacgccaagccctggtccaagatcgccctcgagaacgagttcagcatcggggagaacagctacgaggtcatccggcgcgagaagctgttcaaggagatccagcagttcgagtccgagatcctgttccggagcggctgggacggcatcaaccaccccgcccagctcgaggacaaccgcaacccgaagttcaagatgtacatcgtgaacgggatcctgcggaagtccgccggcctgtacagccagggggaggacatctggttcgagtacaacgcggacttcaacaacctcgacgccgacgtgctggagaccaagtccgagctggtccagctcgccttcctggtgaccgccatccgcaacaagttcgcccacaaccagctgcccgcgaaggagttctacttctacatccgggccaagtacggcttcgccgacgagcccagcgtggccctcgtctacctgaacttcaccaagtacgcgatcaacgagttcaagaaggtgatgatctga

SEQ ID NO: 11177 - RNA, 3453 nt, synthetic construct
  misc_feature 1..3453: note = Cas13b variant__Flavobacterium branchiophilum__WP_014084666.1__Cas13b
  source 1..3453: mol_type = other RNA
atggagaacctgaacaagatcctcgacaaggagaacgagatctgcatcagcaagatcttcaacaccaagggcatcgccgcccccatcaccgagaaggcgctggacaacatcaagtccaagcagaagaacgacctgaacaaggaggcccgcctccactacttcagcatcgggcactccttcaagcagatcgacacgaagaaggtgttcgactacgtcctgatcgaggagctgaaggacgagaagccgctcaagttcatcaccctgcagaaggacttcttcaccaaggagttcagcatcaagctgcagaagctcatcaactccatccggaacatcaacaaccactacgtgcacaacttcaacgacatcaacctgaacaagatcgacagcaacgtgttccacttcctgaaggagtccttcgagctcgccatcatcgagaagtactacaaggtcaacaagaagtaccccctggacaacgagatcgtgctgttcctcaaggagctgttcatcaaggacgagaacaccgccctgctcaactacttcacgaacctgagcaaggacgaggccatcgagtacatcctgaccttcaccatcaccgagaacaagatctggaacatcaacaacgagcacaacatcctcaacatcgagaagggcaagtacctgacgttcgaggcgatgctgttcctcatcaccatcttcctgtacaagaacgaggccaaccacctcctccccaagctgtacgacttcaagaacaacaagtccaagcaggagctgttcaccttcttcagcaagaagttcacctcccaggacatcgacgccgaggaggggcacctcatcaagttccgcgacatgatccagtacctgaaccactaccccacggcctggaacaacgacctgaagctcgagagcgagaacaagaacaagatcatgaccaccaagctgatcgactccatcatcgagttcgagctgaacagcaactacccgtccttcgcgaccgacatccagttcaagaaggaggccaaggccttcctcttcgccagcaacaagaagcggaaccagacgtccttcagcaacaagtcctacaacgaggagatccgccacaacccccacatcaagcagtaccgggacgagatcgccagcgcgctgacccccatcagcttcaacgtgaaggaggacaagttcaagatcttcgtcaagaagcacgtgctggaggagtacttccccaactccatcggctacgagaagttcctcgagtacaacgacttcaccgagaaggagaaggaggacttcgggctgaagctgtacagcaacccgaagaccaacaagctcatcgagcgcatcgacaaccacaagctggtgaagtcccacggccggaaccaggaccgcttcatggacttcagcatgcggttcctggccgagaacaactacttcggcaaggacgccttcttcaagtgctacaagttctacgacacgcaggagcaggacgagttcctccagtccaacgagaacaacgacgacgtcaagttccacaaggggaaggtgaccacctacatcaagtacgaggagcacctgaagaactacagctactgggactgccccttcgtggaggagaacaactccatgagcgtcaagatctccatcggcagcgaggagaagatcctgaagatccagcgcaacctcatgatctacttcctggagaacgccctgtacaacgagaacgtggagaaccaggggtacaagctggtgaacaactactaccgggagctcaagaaggacgtcgaggagtccatcgccagcctggacctgatcaagtccaaccccgacttcaagagcaagtacaagaagatcctccccaagcgcctgctgcacaactacgcgccggccaagcaggacaaggcccccgagaacgccttcgagaccctcctgaagaaggccgacttccgggaggagcagtacaagaagctgctcaagaaggcggagcacgagaagaacaaggaggacttcgtgaagcgcaacaagggcaagcagttcaagctgcacttcatccggaaggcctgccagatgatgtacttcaaggagaagtacaacacgctgaaggaggggaacgccgccttcgagaagaaggaccccgtgatcgagaagcgcaagaacaaggagcacgagttcggccaccacaagaacctcaacatcacccgggaggagttcaacgactactgcaagtggatgttcgccttcaacggcaacgactcctacaagaagtacctgcgcgacctgttcagcgagaagcacttcttcgacaaccaggagtacaagaacctcttcgagtccagcgtcaacctggaggcgttctacgccaagaccaaggagctgttcaagaagtggatcgagaccaacaagcccacgaacaacgagaaccggtacaccctcgagaactacaagaacctgatcctgcagaagcaggtcttcatcaacgtgtaccacttctccaagtacctcatcgacaagaacctgctgaacagcgagaacaacgtgatccagtacaagagcctcgagaacgtggagtacctgatctccgacttctacttccagagcaagctgtccatcgaccagtacaagacctgcgggaagctgttcaacaagctcaagagcaacaagctggaggactgcctgctgtacgagatcgcctacaactacatcgacaagaagaacgtgcacaagatcgacatccagaagatcctgacctccaagatcatcctcacgatcaacgacgccaacaccccgtacaagatcagcgtccccttcaacaagctggagcgctacaccgagatgatcgcgatcaagaaccagaacaacctgaaggcccggttcctcatcgacctgcccctgtacctctccaagaacaagatcaagaagggcaaggacagcgccgggtacgagatcatcatcaagaacgacctggagatcgaggacatcaacaccatcaacaacaagatcatcaacgactccgtgaagttcacggaggtcctgatggagctcgagaagtacttcatcctgaaggacaagtgcatcctgagcaagaactacatcgacaactccgagatccccagcctcaagcagttctccaaggtgtggatcaaggagaacgagaacgagatcatcaactaccgcaacatcgcctgccacttccacctcccgctgctggagaccttcgacaacctgctgctcaacgtggagcagaagttcatcaaggaggagctgcagaacgtcagcaccatcaacgacctgtccaagccccaggagtacctcatcctgctgttcatcaagttcaagcacaacaacttctacctcaacctgttcaacaagaacgagagcaagaccatcaagaacgacaaggaggtgaagaagaaccgcgtgctgcagaagttcatcaaccaggtcatcctcaagaagaagtga

SEQ ID NO: 11178 - RNA, 3642 nt, synthetic construct
  misc_feature 1..3642: note = Cas13b variant__Flavobacterium columnare__WP_060381855.1__Cas13b
  source 1..3642: mol_type = other RNA
atgagctccaagaacgagagctacaacaagcagaagaccttcaaccactacaagcaggaggacaagtacttcttcggcgggttcctgaacaacgccgacgacaacctccgccaggtgggcaaggagttcaagacccggatcaacttcaaccacaacaacaacgagctggcctccgtcttcaaggactacttcaacaaggagaagtccgtggcgaagcgcgagcacgccctgaacctcctgtccaactacttccccgtgctggagcggatccagaagcacacgaaccacaacttcgagcagacccgcgagatcttcgagctcctgctggacaccatcaagaagctccgggactactacacccaccactaccacaagccgatcacgatcaaccccaaggtctacgacttcctggacgacaccctgctcgacgtgctgatcaccatcaagaagaagaaggtgaagaacgacaccagccgcgagctgctcaaggagaagttccggcccgagctgacgcagctgaagaaccagaagcgcgaggagctcatcaagaaggggaagaagctgctggaggagaacctcgagaacgccgtcttcaaccactgcctgcggcccttcctggaggagaacaagaccgacgacaagcagaacaagaccgtgtccctccgcaagtaccgcaagagcaagccgaacgaggagacctccatcacgctgacccagagcggcctggtgttcctcatctccttcttcctgcaccggaaggagttccaggtcttcaccagcgggctggagggcttcaaggccaaggtgaacaccatcaaggaggaggagatctccctcaacaagaacaacatcgtgtacatgatcacgcactggagctactcctactacaacttcaagggcctgaagcaccggatcaagaccgaccagggggtcagcaccctggagcagaacaacaccacgcactccctcaccaacaccaacaccaaggaggccctgctgacgcagatcgtggactacctcagcaaggtgcccaacgagatctacgagaccctgtccgagaagcagcagaaggagttcgaggaggacatcaacgagtacatgcgcgagaaccccgagaacgaggacagcaccttcagctccatcgtcagccacaaggtgatccggaagcgctacgagaacaagttcaactacttcgcgatgcggttcctggacgagtacgccgagctccccaccctgcgcttcatggtgaacttcggcgactacatcaaggaccggcagaagaagatcctggagtccatccagttcgacagcgagcgcatcatcaagaaggagatccacctcttcgagaagctggggctggtcacggagtacaagaagaacgtgtacctcaaggagacctccaacatcgacctgagccggttcccgctgttcccctcccccagctacgtgatggccaacaacaacatccccttctacatcgactcccgcagcaacaacctcgacgagtacctgaaccagaagaagaaggcccagtcccagaaccgcaagcggaacctgaccttcgagaagtacaacaaggagcagagcaaggacgcgatcatcgccatgctgcagaaggagatcggcgtcaaggacctccagcagcgctccaccatcgggctgctgagctgcaacgagctcccgtccatgctgtacgaggtgatcgtgaaggacatcaagggcgccgagctggagaacaagatcgcccagaagatccgggagcagtaccagagcatccgcgacttcacgctcgacagcccccagaaggacaacatccccaccaccctgaccaagacgatcagcaccgacacctccgtcaccttcgagaaccagcccatcgacatcccgcggctgaagaacgccctccagaaggagctgaccctgacgcaggagaagctcctgaacgtgaagcagcacgagatcgaggtcgacaactacaaccgcaacaagaacacctacaagttcaagaaccagcccaaggacaaggtggacgacaacaagctgcagcggaagtacgtgttctaccgcaacgagatcggccaggaggcgaactggctcgccagcgacctgatccacttcatgaagaacaagagcctgtggaaggggtacatgcacaacgagctccagtccttcctggccttcttcgaggacaagaagaacgactgcatcgccctgctcgagaccgtcttcaacctgaaggaggactgcatcctgaccaaggacctcaagaacctgttcctgaagcacggcaacttcatcgacttctacaaggagtacctcaagctgaaggaggacttcctgaacacggagagcaccttcctcgagaacgggttcatcggcctgccgcccaagatcctgaagaaggagctctccaagcggctgaactacatcttcatcgtgttccagaagcgccagttcatcatcaaggagctggaggagaagaagaacaacctctacgccgacgcgatcaacctgagccggggcatcttcgacgagaagcccaccatgatccccttcaagaagcccaaccccgacgagttcgcctcctggttcgtggccagctaccagtacaacaactaccagtccttctacgagctgaccccggacaagatcgagaacgacaagaagaagaagtacaagaacctccgcgccatcaacaaggtcaagatccaggactactacctgaagctgatggtggacacgctctaccaggacctgttcaaccagcccctggacaagagcctctccgacttctacgtgagcaagaccgaccgggagaagatcaaggccgacgcgaaggcctaccagaagcgcaacgactccttcctgtggaacaaggtcatccacctgagcctccagaacaaccggatcaccgccaaccccaagctgaaggacatcgggaagtacaagcgcgccctgcaggacgagaagatcgccaccctcctgacgtacgacgaccggacctggacctacgcgctgcagaagcccgagaaggagaacgagaacgactacaaggagctccactacaccgccctgaacatggagctgcaggagtacgagaaggtgcgctccaagaagctcctgaagcaggtccaggagctggagaagcagatcctcgacaagttctacgacttcagcaacaacgccacgcacccggaggacctggagatcgaggacaagaagggcaagcggcaccccaacttcaagctgtacatcaccaaggccctcctgaagaacgagtccgagatcatcaacctggagaacatcgacatcgagatcctcatcaagtactacgactacaacaccgagaagctgaaggagaagatcaagaacatggacgaggacgagaaggcgaagatcgtgaacaccaaggagaactacaacaagatcacgaacgtgctgatcaagaaggccctcgtgctgatcatcatccgcaacaagatggcccacaaccagtacccgcccaagttcatctacgacctggccacccgcttcgtccccaagaaggaggaggagtacttcgcctgctacttcaaccgggtgttcgagaccatcaccacggagctctgggagaacaagaagaaggcgaaggagatcgtgtga

SEQ ID NO: 11179 - RNA, 3540 nt, synthetic construct
  misc_feature 1..3540: note = Cas13b variant__Flavobacterium columnare__WP_014165541.1__Cas13b
  source 1..3540: mol_type = other RNA
atgagctccaagaacgagagctacaacaagcagaagacgttcaaccactacaagcaggaggacaagtacttcttcggcgggttcctgaacaacgccgacgacaacctccgccaggtgggcaaggagttcaagacccggatcaacttcaaccacaacaacaacgagctggcctccgtcttcaaggactacttcaacaaggagaagtccgtggcgaagcgcgagcacgccctgaacctcctgtccaactacttccccgtgctggagcggatccagaagcacacgaaccacaacttcgagcagacccgcgagatcttcgagctcctgctggacaccatcaagaagctccgggactactacacccaccactaccacaagcccatcacgatcaaccccaagatctacgacttcctggacgacaccctgctcgacgtcctgatcaccatcaagaagaagaaggtgaagaacgacaccagccgcgagctgctcaaggagaagctgcggcccgagctgacgcagctcaagaaccagaagcgcgaggagctgatcaagaaggggaagaagctgctcgaggagaacctggagaacgccgtgttcaaccactgcctgcggcccttcctcgaggagaacaagaccgacgacaagcagaacaagaccgtctccctgcgcaagtaccgcaagagcaagccgaacgaggagacctccatcacgctgacccagagcggcctcgtgttcctgatgtccttcttcctgcaccggaaggagttccaggtgttcaccagcgggctcgagggcttcaaggccaaggtcaacaccatcaaggaggaggagatctccctgaacaagaacaacatcgtgtacatgatcacgcactggagctactcctactacaacttcaagggcctgaagcaccggatcaagaccgaccagggggtgagcaccctcgagcagaacaacaccacgcactccctgaccaacaccaacaccaaggaggccctgctcacgcagatcgtcgactacctgagcaaggtgcccaacgagatctacgagaccctgtccgagaagcagcagaaggagttcgaggaggacatcaacgagtacatgcgcgagaaccccgagaacgaggacagcaccttcagctccatcgtgagccacaaggtcatccggaagcgctacgagaacaagttcaactacttcgcgatgcggttcctcgacgagtacgccgagctgcccaccctgcgcttcatggtgaacttcggcgactacatcaaggaccggcagaagaagatcctcgagtccatccagttcgacagcgagcgcatcatcaagaaggagatccacctgttcgagaagctgtccctcgtgacggagtacaagaagaacgtctacctgaaggagaccagcaacatcgacctgtcccggttccccctcttccccaaccccagctacgtgatggccaacaacaacatccccttctacatcgactcccgcagcaacaacctggacgagtacctgaaccagaagaagaaggcccagtcccagaacaagaagcgcaacctgaccttcgagaagtacaacaaggagcagagcaaggacgcgatcatcgccatgctccagaaggagatcggggtgaaggacctgcagcagcggtccaccatcggcctgctcagctgcaacgagctgccgtccatgctgtacgaggtcatcgtgaaggacatcaagggggccgagctcgagaacaagatcgcccagaagatccgcgagcagtaccagagcatccgggacttcacgctggacagcccccagaaggacaacatccccaccaccctgatcaagaccatcaacacggacagctccgtgaccttcgagaaccagcccatcgacatcccgcgcctcaagaacgccatccagaaggagctgaccctgacccaggagaagctcctgaacgtcaaggagcacgagatcgaggtggacaactacaaccggaacaagaacacctacaagttcaagaaccagcccaagaacaaggtcgacgacaagaagctgcagcgcaagtacgtgttctaccggaacgagatccgccaggaggcgaactggctcgccagcgacctgatccacttcatgaagaacaagagcctgtggaagggctacatgcacaacgagctccagtccttcctggccttcttcgaggacaagaagaacgactgcatcgccctgctcgagacggtgttcaacctgaaggaggactgcatcctgaccaagggcctcaagaacctgttcctgaagcacgggaacttcatcgacttctacaaggagtacctcaagctgaaggaggacttcctgaacaccgagagcaccttcctcgagaacggcctgatcgggctgccgcccaagatcctcaagaaggagctgtccaagcggttcaagtacatcttcatcgtcttccagaagcgccagttcatcatcaaggagctggaggagaagaagaacaacctctacgccgacgcgatcaacctgagccggggcatcttcgacgagaagccgacgatgatccccttcaagaagcccaaccccgacgagttcgcctcctggttcgtggccagctaccagtacaacaactaccagtccttctacgagctgaccccggacatcgtggagcgcgacaagaagaagaagtacaagaacctccgggccatcaacaaggtcaagatccaggactactacctgaagctgatggtggacaccctctaccaggacctgttcaaccagcccctggacaagagcctctccgacttctacgtgagcaaggccgagcgcgagaagatcaaggcggacgccaaggcctaccagaagcggaacgactccagcctgtggaacaaggtcatccacctgtccctccagaacaaccgcatcaccgccaaccccaagctgaaggacatcggcaagtacaagcgggccctgcaggacgagaagatcgcgacgctcctgacctacgacgaccgcacctggacctacgccctgcagaagcccgagaaggagaacgagaacgactacaaggagctccactacacggccctgaacatggagctgcaggagtacgagaaggtgcggagcaaggagctcctgaagcaggtccaggagctggagaagcagatcctcgaggagtacaccgacttcctgtccacccagatccacccggccgacttcgagcgcgaggggaaccccaacttcaagaagtacctggcgcacagcatcctcgagaacgaggacgacctggacaagctgcccgagaaggtggaggccatgcgcgagctcgacgagaccatcacgaacccgatcatcaagaaggccatcgtgctgatcatcatccggaacaagatggcccacaaccagtacccgcccaagttcatctacgacctggccaaccgcttcgtgcccaagaaggaggaggagtacttcgcgacctacttcaaccgggtcttcgagaccatcaccaaggagctctgggagaacaaggagaagaaggacaagacccaggtgtga

SEQ ID NO: 11180 - RNA, 3642 nt, synthetic construct
  misc_feature 1..3642: note = Cas13b variant__Flavobacterium columnare__WP_063744070.1__Cas13b
  source 1..3642: mol_type = other RNA
atgagctccaagaacgagagctacaacaagcagaagaccttcaaccactacaagcaggaggacaagtacttcttcggcgggttcctgaacaacgccgacgacaacctccgccaggtgggcaaggagttcaagacccggatcaacttcaaccacaacaacaacgagctggcctccgtcttcaaggactacttcaacaaggagaagtccgtggcgaagcgcgagcacgccctgaacctcctgtccaactacttccccgtgctggagcggatccagaagcacacgaaccacaacttcgagcagacccgcgagatcttcgagctcctgctggacaccatcaagaagctccgggactactacacccaccactaccacaagccgatcacgatcaaccccaagatctacgacttcctggacgacaccctgctcgacgtcctgatcaccatcaagaagaagaaggtgaagaacgacaccagccgcgagctgctcaaggagaagctgcggcccgagctgacgcagctcaagaaccagaagcgcgaggagctgatcaagaaggggaagaagctgctcgaggagaacctggagaacgccgtgttcaaccactgcctgcggcccttcctcgaggagaacaagaccgacgacaagcagaacaagaccgtctccctgcgcaagtaccgcaagagcaagccgaacgaggagacctccatcacgctgacccagagcggcctcgtgttcctgatgtccttcttcctgcaccggaaggagttccaggtgttcaccagcgggctcgagggcttcaaggccaaggtcaacaccatcaaggaggagaagatctccctgaacaagaacaacatcgtgtacatgatcacgcactggagctactcctactacaacttcaagggcctgaagcaccggatcaagaccgaccagggggtgagcaccctcgagcagaacaacaccacgcactccctgaccaacaccaacaccaaggaggccctgctcacgcagatcgtcgactacctgagcaaggtgcccaacgagatctacgagaccctgtccgagaagcagcagaaggagttcgaggaggacatcaacgagtacatgcgcgagaaccccgagaacgaggacagcaccttcagctccatcgtgagccacaaggtcatccggaagcgctacgagaacaagttcaactacttcgcgatgcggttcctcgacgagtacgccgagctgcccaccctgcgcttcatggtgaacttcggcgactacatcaaggaccggcagaagaagatcctcgagtccatccagttcgacagcgagcgcatcatcaagaaggagatccacctgttcgagaagctggggctcgtgacggagtacaagaagaacgtctacctgaaggagacctccaacatcgacctgagccggttccccctcttcccctcccccagctacgtgatggccaacaacaacatccccttctacatcgactcccgcagcaacaacctggacgagtacctgaaccagaagaagaaggcccagtcccagaaccgcaagcggaacctgaccttcgagaagtacaacaaggagcagagcaaggacgcgatcatcgccatgctccagaaggagatcggcgtgaaggacctgcagcagcgctccaccatcgggctgctcagctgcaacgagctgccgtccatgctgtacgaggtcatcgtgaaggacatcaagggcgccgagctcgagaacaagatcgcccagaagatccgggagcagtaccagagcatccgcgacttcacgctgaacagcccccagaaggacaacatccccaccaccctgatcaagaccatcagcacggacacctccgtgaccttcgagaaccagcccatcgacatcccgcggctcaagaacgccatccagaaggagctggcgctgacccaggagaagctcctgaacgtcaagcagcacgagatcgaggtgaacaactacaaccgcaacaagaacacctacaagttcaagaaccagcccaaggacaaggtcgacgacaacaagctgcagcggaagtacgtgttctaccgcaacgagatcggccaggaggccaactggctcgccagcgacctgatccacttcatgaagaacaagagcctgtggaaggggtacatgcacaacgagctccagtccttcctggccttcttcgaggacaagaagaacgactgcatcgccctgctcgagacggtgttcaacctgaaggaggactgcatcctgaccaaggacctcaagaacctgttcctgaagcacggcaacttcatcgacttctacaaggagtacctcaagctgaaggaggacttcctgaacaccgagagcaccttcctcgagaacgggttcatcggcctgccgcccaagatcctgaagaaggagctctccaagcggctgaactacatcttcatcgtcttccagaagcgccagttcatcatcaaggagctggaggagaagaagaacaacctctacgcggacgccatcaacctgagccggggcatcttcgacgagaagccgacgatgatccccttcaagaagcccaaccccgacgagttcgcctcctggttcgtggccagctaccagtacaacaactaccagtccttctacgagctgaccccggacaagatcgagaacgacaagaagaagaagtacaagaacctccgcgccatcaacaaggtgaagatccaggactactacctgaagctgatggtcgacaccctctaccaggacctgttcaaccagcccctggacaagagcctctccgacttctacgtgagcaagaccgaccgggagaagatcaaggcggacgccaaggcctaccagaagcgcaacgactccttcctgtggaacaaggtgatccacctgagcctccagaacaaccggatcacggccaaccccaagctgaaggacatcgggaagtacaagcgcgccctgcaggacgagaagatcgcgaccctcctgacctacgacgaccggacctggacgtacgccctgcagaagcccgagaaggagaacgagaacgactacaaggagctccactacaccgccctgaacatggagctgcaggagtacgagaaggtccgctccaagaagctcctgaagcaggtccaggagctggagaagcagatcctcgacaagttctacgacttcagcaacaacgccacccacccggaggacctggagatcgaggacaagaagggcaagcggcaccccaacttcaagctgtacatcaccaaggcgctcctgaagaacgagtccgagatcatcaacctggagaacatcgacatcgagatcctcatcaagtactacgactacaacacggagaagctgaaggagaagatcaagaacatggacgaggacgagaaggccaagatcgtgaacaccaaggagaactacaacaagatcaccaacgtgctgatcaagaaggccctcgtgctgatcatcatccgcaacaagatggcccacaaccagtacccgcccaagttcatctacgacctggccacccgcttcgtgcccaagaaggaggaggagtacttcgcgtgctacttcaaccgggtcttcgagacgatcaccaccgagctctgggagaacaagaagaaggccaaggagatcgtgtga

SEQ ID NO: 11181 - RNA, 3645 nt, synthetic construct
  misc_feature 1..3645: note = Cas13b variant__Flavobacterium columnare__WP_065213424.1__Cas13b
  source 1..3645: mol_type = other RNA
atgagctccaagaacgagagctacaacaagcagaagacgttcaaccactacaagcaggaggacaagtacttcttcggcgggttcctgaacaacgccgacgacaacctccgccaggtgggcaaggagttcaagacccggatcaacttcaaccacaacaacaacgagctggcctccgtcttcaaggactacttcaacaaggagaagtccgtggcgaagcgcgagcacgccctgaacctcctgtccaactacttccccgtgctggagcggatccagaagcacacgaaccacaacttcgagcagacccgcgagatcttcgagctcctgctggacaccatcaagaagctccgggactactacacccaccactaccacaagccgatcacgatcaaccccaagatctacgacttcctggacgacaccctgctcgacgtcctgatcaccatcaagaagaagaaggtgaagaacgacaccagccgcgagctgctcaaggagaagctgcggcccgagctgacgcagctcaagaaccagaagcgcgaggagctgatcaagaaggggaagaagctgctcgaggagaacctggagaacgccgtgttcaaccactgcctgatccccttcctcgaggagaacaagaccgacgacaagcagaacaagaccgtctccctgcggaagtaccgcaagagcaagccgaacgaggagacctccatcacgctgacccagagcggcctcgtgttcctgatgtccttcttcctgcaccggaaggagttccaggtgttcaccagcgggctcgagcgcttcaaggccaaggtcaacaccatcaaggaggaggagatctccctgaacaagaacaacatcgtgtacatgatcacgcactggagctactcctactacaacttcaagggcctgaagcaccggatcaagaccgaccagggcgtgagcaccctcgagcagaacaacaccacgcactccctgaccaacaccaacaccaaggaggccctgctcacgcagatcgtcgactacctgagcaaggtgcccaacgagatctacgagaccctgtccgagaagcagcagaaggagttcgaggaggacatcaacgagtacatgcgcgagaaccccgagaacgaggacagcaccttcagctccatcgtgagccacaaggtcatccggaagcgctacgagaacaagttcaactacttcgcgatgcggttcctcgacgagtacgccgagctgcccaccctgcgcttcatggtgaacttcggggactacatcaaggaccggcagaagaagatcctcgagtccatccagttcgacagcgagcgcatcatcaagaaggagatccacctgttcgagaagctgtccctcgtgacggagtacaagaagaacgtctacctgaaggagaccagcaacatcgacctgtcccggttccccctcttccccaaccccagctacgtgatggccaacaacaacatccccttctacatcgactcccgcagcaacaacctggacgagtacctgaaccagaagaagaaggcccagtcccagaacaagaagcgcaacctgaccttcgagaagtacaacaaggagcagagcaaggacgcgatcatcgccatgctccagaaggagatcggcgtgaaggacctgcagcagcggtccaccatcgggctgctcagctgcaacgagctgccgtccatgctgtacgaggtcatcgtgaaggacatcaagggcgccgagctcgagaacaagatcgcccagaagatccgcgagcagtaccagagcatccgggacttcacgctggacagcccccagaaggacaacatccccaccaccctgatcaagaccatcaacacggacagctccgtgaccttcgagaaccagcccatcgacatcccgcgcctcaagaacgccctgcagaaggagctgaccctcacccaggagaagctgctgaacgtcaaggagcacgagatcgaggtggacaactacaaccggaacaagaacacctacaagttcaagaaccagcccaagaacaaggtcgacgacaagaagctccagcgcaagtacgtgttctaccggaacgagatccgccaggaggcgaactggctggccagcgacctgatccacttcatgaagaacaagagcctctggaaggggtacatgcacaacgagctgcagtccttcctggccttcttcgaggacaagaagaacgactgcatcgccctcctggagacggtgttcaacctgaaggaggactgcatcctcaccaagggcctgaagaacctgttcctcaagcacggcaacttcatcgacttctacaaggagtacctgaagctgaaggaggacttcctcagcaccgagtccaccttcctggagaacgggttcatcggcctgccgcccaagatcctcaagaaggagctgagcaagcggctgaagtacatcttcatcgtcttccagaagcgccagttcatcatcaaggagctcgaggagaagaagaacaacctgtacgccgacgcgatcaacctgtcccgggggatcttcgacgagaagccgacgatgatccccttcaagaagcccaaccccgacgagttcgccagctggttcgtggcctcctaccagtacaacaactaccagagcttctacgagctcaccccggacatcgtggagcgcgacaagaagaagaagtacaagaacctgcgggccatcaacaaggtcaagatccaggactactacctgaagctcatggtggacaccctgtaccaggacctgttcaaccagcccctcgacaagtccctgagcgacttctacgtgtccaaggccgagcgcgagaagatcaaggcggacgccaaggcctaccagaagctgaacgacagctccctctggaacaaggtcatccacctgagcctgcagaacaaccggatcaccgccaaccccaagctcaaggacatcggcaagtacaagcgcgccctgcaggacgagaagatcgcgacgctgctcacctacgacgcccggacctggacctacgccctgcagaagcccgagaaggagaacgagaacgactacaaggagctgcactacacggccctcaacatggagctgcaggagtacgagaaggtgcgctccaaggagctgctcaagcaggtccaggagctggagaagaagatcctggacaagttctacgacttcagcaacaacgcgtcccacccggaggacctcgagatcgaggacaagaagggcaagcggcaccccaacttcaagctgtacatcaccaaggccctgctcaagaacgagagcgagatcatcaacctggagaacatcgacatcgagatcctgctcaagtactacgactacaacaccgaggagctgaaggagaagatcaagaacatggacgaggacgagaaggccaagatcatcaacaccaaggagaactacaacaagatcacgaacgtgctgatcaagaaggccctcgtgctgatcatcatccgcaacaagatggcccacaaccagtacccgcccaagttcatctacgacctggcgaaccgcttcgtgcccaagaaggaggaggagtacttcgccacctacttcaaccgggtcttcgagaccatcaccaaggagctctgggagaacaaggagaagaaggacaagacccaggtgtga

SEQ ID NO: 11182 - RNA, 3468 nt, synthetic construct
  misc_feature 1..3468: note = Cas13b variant__Flavobacterium sp.__WP_045968377.1__Cas13b
  source 1..3468: mol_type = other RNA
atggacaacaacatcaccgtggagaagaccgagctgggcctcgggatcacgtacaaccacgacaaggtcgaggacaagcactacttcggcgggttcttcaacctggcccagaacaacatcgacctggtggcccaggagttcaagaagcgcctcctgatccagggcaaggacagcatcaacatcttcgcgaactacttctccgaccagtgcagcatcaccaacctggagcgggggatcaagatcctcgccgagtacttccccgtggtctcctacatcgacctggacgagaagaacaagagcaagtccatccgcgagcacctgatcctcctgctggagaccatcaacaacctccggaactactacacccactactaccacaagaagatcatcatcgacggcagcctgttcccgctgctcgacacgatcctgctgaaggtggtgctcgagatcaagaagaagaagctgaaggaggacaagaccaagcagctgctcaagaagggcctggagaaggagatgaccatcctgttcaacctcatgaaggccgagcagaaggagaagaagatcaaggggtggaacatcgacgagaacatcaagggcgccgtcctgaaccgcgccttctcccacctcctctacaacgacgagctgagcgactaccggaagtccaagtacaacaccgaggacgagacgctgaaggacaccctcaccgagagcgggatcctgttcctgctctccttcttcctgaacaagaaggagcaggagcagctgaaggcgaacatcaagggctacaaggggaagatcgccagcatccccgacgaggagatcaccctcaagaacaactccctgcgcaacatggccacgcactggacctacagccacctgacctacaagggcctcaagcaccggatcaagaccgaccacgagaaggagacgctgctggtgaacatggtggactacctctccaaggtcccccacgagatctaccagaacctgagcgagcagaacaagtccctgttcctcgaggacatcaacgagtacatgcgcgacaacgaggagaaccacgacagctccgaggccagccgggtgatccaccccgtgatccgcaagcggtacgagaacaagttcgcgtacttcgccatccgcttcctggacgagttcgccgagttcccgaccctgcggttcatggtcaacgtgggcaactacatccacgacaaccgcaagaaggacatcgggggcaccagcctcatcaccaaccggacgatcaagcagcagatcaacgtgttcgggaacctgaccgagatccacaagaagaagaacgactacttcgagaaggaggagaacaaggagaagaccctggagtgggagctgttccccaacccctcctaccacttccagaaggagaacatccccatcttcatcgacctcgagaagtccaaggagaccaacgacctggccaaggagtacgccaaggagaagaagaagatcttcggcagcagccgcaagaagcagcagaacacggcgaagaagaaccgggagaccatcatcaacctggtcttcgacaagtacaagacctccgaccgcaagaccgtgacgttcgagcagccgaccgccctcctgagcttcaacgagctgaactccttcctctacgccttcctggtggagaacaagaccggcaaggagctggagaagatcatcatcgagaagatcgccaaccagtaccagatcctcaagaactgcagctccaccgtcgacaagacgaacgacaacatccccaagagcatcaagaagatcgtgaacaccaccaccgactccttctacttcgaggggaagaagatcgacatcgagaagctggagaaggacatcacgatcgagatcgagaagaccaacgagaagctggagaccatcaaggagaacgaggagagcgcccagaactacaagcggaacgagcgcaacacccagaagcggaagctctaccgcaagtacgtgttcttcaccaacgagatcggcatcgaggcgacgtggatcaccaacgacatcctgcgcttcctggacaacaaggagaactggaaggggtaccagcactccgagctccagaagttcatcagccagtacgacaactacaagaaggaggccctgggcctgctcgagtccgagtggaacctggagagcgacgccttcttcgggcagaacctgaagcggatgttccagtccaacagcaccttcgagaccttctacaagaagtacctcgacaaccgcaagaacacgctggagacctacctgtccgccatcgagaacctcaagaccatgaccgacgtccggcccaaggtgctgaagaagaagtggacggagctgttccgcttcttcgacaagaagatctacctcctgagcaccatcgagaccaagatcaacgagctgatcaccaagcccatcaacctcagccggggcatcttcgaggagaagccgacgttcatcaacggcaagaaccccaacaaggagaacaaccagcacctgttcgccaactggttcatctacgcgaagaagcagaccatcctgcaggacttctacaacctccccctggagcagcccaaggccatcaccaacctgaagaagcacaagtacaagctcgagcgctccatcaacaacctgaagatcgaggacatctacatcaagcagatggtggacttcctgtaccagaagctgttcgagcagagcttcatcgggtccctgcaggacctgtacaccagcaaggagaagcgggagatcgagaagggcaaggccaagaacgagcagacgccggacgagtccttcatctggaagaagcaggtcgagatcaacacccacaacgggcgcatcatcgccaagaccaagatcaaggacatcggcaagttcaagaacctcctgaccgacaacaagatcgcccacctgatcagctacgacgaccggatctgggacttctccctcaacaacgacggggacatcacgaagaagctgtacagcatcaacaccgagctggagtcctacgagaccatccgccgggagaagctcctgaagcagatccagcagttcgagcagttcctgctcgagcaggagaccgagtacagcgcggagcgcaagcaccccgagaagttcgagaaggactgcaaccccaacttcaagaagtacatcatcgagggcgtgctgaacaagatcatccccaaccacgagatcgaggagatcgagatcctgaagtccaaggaggacgtcttcaagatcaacttcagcgacatcctcatcctgaacaacgacaacatcaagaagggctacctgctcatcatgatccggaacaagttcgcccacaaccagctgatcgacaagaacctgttcaacttctccctccagctgtacagcaagaacgagaacgagaacttctccgagtacctgaacaaggtgtgccagaacatcatccaggagttcaaggagaagctcaagtga

SEQ ID NO: 11183 - RNA, 3480 nt, synthetic construct
  misc_feature 1..3480: note = Cas13b variant__Myroides odoratimimus__EHO06562.1__Cas13b
  source 1..3480: mol_type = other RNA
atgaaggacatcctgaccaccgacacgaccgagaagcagaaccgcttctacagccacaagatcgccgacaagtacttcttcggcgggtacttcaacctcgcctccaacaacatctacgaggtgttcgaggaggtcaacaagcggaacaccttcggcaagctggcgaagcgcgacaacgggaacctgaagaactacatcatccacgtgttcaaggacgagctcagcatctccgacttcgagaagcgggtggccatcttcgccagctacttccccatcctggagaccgtcgacaagaagtccatcaaggagcgcaaccggacgatcgacctgaccctcagccagcgcatccggcagttccgcgagatgctgatctccctggtgaccgccgtggaccagctccggaacttctacacccactaccaccacagcgacatcgtcatcgagaacaaggtgctggacttcctgaactccagcttcgtgtccacggccctccacgtcaaggacaagtacctgaagaccgacaagaccaaggagttcctgaaggagaccatcgcggccgagctcgacatcctgatcgaggcctacaagaagaagcagatcgagaagaagaacacgcgcttcaaggccaacaagcgggaggacatcctgaacgcgatctacaacgaggccttctggagcttcatcaacgacaaggacaaggacaaggacaaggagaccgtggtggccaagggcgccgacgcctacttcgagaagaaccaccacaagtccaacgacccggacttcgcgctcaacatcagcgagaaggggatcgtctacctgctgtccttcttcctcaccaacaaggagatggacagcctgaaggccaacctgaccggcttcaagggcaaggtggaccgcgagtccgggaacagcatcaagtacatggccacgcagcggatctactccttccacacctaccgcggcctcaagcagaagatccggaccagcgaggagggggtgaaggagaccctgctgatgcagatgatcgacgagctcagcaaggtccccaacgtggtgtaccagcacctgtccacgacccagcagaacagcttcatcgaggactggaacgagtactacaaggactacgaggacgacgtcgagaccgacgacctgtcccgcgtgatccaccccgtgatccggaagcgctacgaggaccggttcaactacttcgccatccgcttcctcgacgagttcttcgacttccccaccctgcggttccaggtccacctgggcgactacgtgcacgaccgccgcacgaagcagctcgggaaggtggagagcgaccggatcatcaaggagaaggtcaccgtgttcgcccgcctgaaggacatcaactccgcgaaggccagctacttccactccctggaggagcaggacaaggaggagctcgacaacaagtggaccctgttcccgaaccccagctacgacttccccaaggagcacaccctgcagcaccagggcgagcagaagaacgccggcaagatcgggatctacgtcaagctccgggacacgcagtacaaggagaaggccgccctggaggaggcgcgcaagtccctgaaccccaaggagcggagcgccaccaaggcctccaagtacgacatcatcacccagatcatcgaggccaacgacaacgtcaagagcgagaagccgctcgtgttcaccggccagcccatcgcctacctgtccatgaacgacatccacagcatgctgttctccctcctgacggacaacgcggagctgaagaagacccccgaggaggtggaggccaagctcatcgaccagatcgggaagcagatcaacgagatcctgagcaaggacaccgacaccaagatcctgaagaagtacaaggacaacgacctgaaggagacggacaccgacaagatcacccgcgacctcgcccgggacaaggaggagatcgagaagctgatcctggagcagaagcagcgcgccgacgactacaactacacctccagcaccaagttcaacatcgacaagtcccggaagcgcaagcacctcctgttcaacgcggagaagggcaagatcggcgtgtggctggccaacgacatcaagcggttcatgttcaaggagagcaagagcaagtggaaggggtaccagcacacggagctccagaagctgttcgcctacttcgacacctccaagagcgacctggagctcatcctgtccaacatggtgatggtcaaggactaccccatcgagctgatcgacctcgtgaagaagtcccgcaccctggtggacttcctgaacaagtacctcgaggcccggctggagtacatcgagaacgtcatcacccgcgtgaagaacagcatcggcacgccgcagttcaagaccgtgcggaaggagtgcttcaccttcctgaagaagtccaactacaccgtcgtgagcctcgacaagcaggtcgagcgcatcctgagcatgcccctgttcatcgagcgggggttcatggacgacaagcccacgatgctcgagggcaagtcctacaagcagcacaaggagaagttcgccgactggttcgtgcactacaaggagaacagcaactaccagaacttctacgacaccgaggtgtacgagatcaccaccgaggacaagcgcgagaaggcgaaggtgacgaagaagatcaagcagcagcagaagaacgacgtcttcaccctgatgatggtgaactacatgctggaggaggtgctcaagctgtccagcaacgaccggctgtccctcaacgagctgtaccagaccaaggaggagcgcatcgtcaacaagcaggtcgccaaggacacccaggagcgcaacaagaactacatctggaacaaggtggtggacctgcagctctgcgacgggctggtgcacatcgacaacgtgaagctgaaggacatcggcaacttccggaagtacgagaacgacagccgcgtcaaggagttcctcacgtaccagtccgacatcgtgtggagcgcctacctgtccaacgaggtggacagcaacaagctgtacgtcatcgagcggcagctcgacaactacgagagcatccgctccaaggagctgctgaaggaggtgcaggagatcgagtgcagcgtgtacaaccaggtcgccaacaaggagtccctcaagcagagcggcaacgagaacttcaagcagtacgtgctgcaggggctgctccccatcggcatggacgtgcgggagatgctgatcctgtccaccgacgtcaagttcaagaaggaggagatcatccagctcgggcaggccggcgaggtggagcaggacctgtacagcctgatctacatccgcaacaagttcgcgcacaaccagctcccgatcaaggagttcttcgacttctgcgagaacaactaccggtccatcagcgacaacgagtactacgccgagtactacatggagatcttccgctccatcaaggagaagtacgccaactga

SEQ ID NO: 11184 - RNA, 3474 nt, synthetic construct
  misc_feature 1..3474: note = Cas13b variant__Myroides odoratimimus__WP_006261414.1__Cas13b
  source 1..3474: mol_type = other RNA
atgaaggacatcctgaccaccgacacgaccgagaagcagaaccgcttctacagccacaagatcgccgacaagtacttcttcggcgggtacttcaacctcgcctccaacaacatctacgaggtgttcgaggaggtcaacaagcggaacaccttcggcaagctggcgaagcgcgacaacgggaacctgaagaactacatcatccacgtgttcaaggacgagctcagcatctccgacttcgagaagcgggtggccatcttcgccagctacttccccatcctggagaccgtcgacaagaagtccatcaaggagcgcaaccggacgatcgacctgaccctcagccagcgcatccggcagttccgcgagatgctgatctccctggtgaccgccgtggaccagctccggaacttctacacccactaccaccacagcgagatcgtcatcgagaacaaggtgctggacttcctgaactccagcctcgtgtccacggccctgcacgtcaaggacaagtacctgaagaccgacaagaccaaggagttcctcaaggagaccatcgcggccgagctggacatcctgatcgaggcctacaagaagaagcagatcgagaagaagaacacgcgcttcaaggccaacaagcgggaggacatcctcaacgcgatctacaacgaggccttctggagcttcatcaacgacaaggacaaggacaaggagaccgtggtggccaagggcgccgacgcctacttcgagaagaaccaccacaagtccaacgacccggacttcgcgctgaacatcagcgagaaggggatcgtctacctgctctccttcttcctgaccaacaaggagatggacagcctgaaggccaacctcaccggcttcaagggcaaggtggaccgcgagtccgggaacagcatcaagtacatggccacgcagcggatctactccttccacacctaccgcggcctgaagcagaagatccggaccagcgaggagggggtgaaggagaccctgctcatgcagatgatcgacgagctgagcaaggtccccaacgtggtgtaccagcacctgtccacgacccagcagaacagcttcatcgaggactggaacgagtactacaaggactacgaggacgacgtcgagaccgacgacctctcccgcgtgatccaccccgtgatccggaagcgctacgaggaccggttcaactacttcgccatccgcttcctggacgagttcttcgacttccccaccctgcggttccaggtccacctcggcgactacgtgcacgaccgccgcacgaagcagctggggaaggtggagagcgaccggatcatcaaggagaaggtcaccgtgttcgcccgcctgaaggacatcaactccgcgaaggccaactacttccacagcctcgaggagcaggacaaggaggagctggacaacaagtggaccctgttcccgaacccctcctacgacttccccaaggagcacaccctccagcaccagggcgagcagaagaacgccggcaagatcgggatctacgtcaagctgcgggacacgcagtacaaggagaaggccgccctggaggaggcgcgcaagagcctcaaccccaaggagcggtccgccaccaaggccagcaagtacgacatcatcacccagatcatcgaggccaacgacaacgtgaagtccgagaagccgctggtgttcaccggccagcccatcgcctacctgagcatgaacgacatccactccatgctgttcagcctgctgacggacaacgcggagctcaagaagacccccgaggaggtcgaggccaagctgatcgaccagatcgggaagcagatcaacgagatcctgtccaaggacaccgacaccaagatcctgaagaagtacaaggacaacgacctcaaggagacggacaccgacaagatcacccgcgacctggcccgggacaaggaggagatcgagaagctgatcctcgagcagaagcagcgcgccgacgactacaactacaccagctccaccaagttcaacatcgacaagagccggaagcgcaagcacctcctgttcaacgcggagaagggcaagatcggcgtgtggctcgccaacgacatcaagcggttcatgacggaggagttcaagtccaagtggaaggggtaccagcacaccgagctgcagaagctgttcgcctactacgacaccagcaagagcgacctcgacctgatcctgtccgacatggtgatggtcaaggactaccccatcgagctcatcgccctggtgaagaagtcccgcaccctggtggacttcctcaacaagtacctggaggcccggctgggctacatggagaacgtcatcacgcgcgtgaagaacagcatcgggaccccgcagttcaagaccgtgcggaaggagtgcttcaccttcctcaagaagtccaactacacggtcgtgagcctggacaagcaggtcgagcgcatcctgagcatgcccctcttcatcgagcggggcttcatggacgacaagcccaccatgctggaggggaagtcctaccagcagcacaaggagaagttcgcggactggttcgtgcactacaaggagaacagcaactaccagaacttctacgacaccgaggtgtacgagatcaccacggaggacaagcgcgagaaggccaaggtgaccaagaagatcaagcagcagcagaagaacgacgtcttcaccctgatgatggtgaactacatgctcgaggaggtgctgaagctgtccagcaacgaccggctctccctgaacgagctgtaccagaccaaggaggagcgcatcgtcaacaagcaggtcgccaaggacacgcaggagcgcaacaagaactacatctggaacaaggtggtggacctccagctgtgcgagggcctggtgcggatcgacaaggtgaagctcaaggacatcggcaacttccgcaagtacgagaacgacagccgggtcaaggagttcctgacctaccagtccgacatcgtgtggagcgcctacctgtccaacgaggtggacagcaacaagctctacgtcatcgagcgccagctggacaactacgagtccatccggagcaaggagctgctcaaggaggtgcaggagatcgagtgcagcgtgtacaaccaggtcgccaacaaggagtccctgaagcagagcgggaacgagaacttcaagcagtacgtgctgcagggcctcgtgcccatcgggatggacgtccgcgagatgctgatcctgtccaccgacgtgaagttcatcaaggaggagatcatccagctcggccaggcgggggaggtggagcaggacctgtacagcctgatctacatccggaacaagttcgcccacaaccagctcccgatcaaggagttcttcgacttctgcgagaacaactaccgctccatcagcgacaacgagtactacgccgagtactacatggagatcttccggtccatcaaggagaagtacaccagctga

SEQ ID NO: 11185 - RNA, 3474 nt, synthetic construct
  misc_feature 1..3474: note = Cas13b variant__Myroides odoratimimus__EKB06014.1__Cas13b
  source 1..3474: mol_type = other RNA
atgaaggacatcctgaccaccgacacgaccgagaagcagaaccgcttctacagccacaagatcgccgacaagtacttcttcggcgggtacttcaacctcgcctccaacaacatctacgaggtgttcgaggaggtcaacaagcggaacaccttcggcaagctggcgaagcgcgacaacgggaacctgaagaactacatcatccacgtgttcaaggacgagctcagcatctccgacttcgagaagcgggtggccatcttcgccagctacttccccatcctggagaccgtcgacaagaagtccatcaaggagcgcaaccggacgatcgacctgaccctcagccagcgcatccggcagttccgcgagatgctgatctccctggtgaccgccgtggaccagctccggaacttctacacccactaccaccacagcgagatcgtcatcgagaacaaggtgctggacttcctgaactccagcctcgtgtccacggccctgcacgtcaaggacaagtacctgaagaccgacaagaccaaggagttcctcaaggagaccatcgcggccgagctggacatcctgatcgaggcctacaagaagaagcagatcgagaagaagaacacgcgcttcaaggccaacaagcgggaggacatcctcaacgcgatctacaacgaggccttctggagcttcatcaacgacaaggacaaggacaaggagaccgtggtggccaagggcgccgacgcctacttcgagaagaaccaccacaagtccaacgacccggacttcgcgctgaacatcagcgagaaggggatcgtctacctgctctccttcttcctgaccaacaaggagatggacagcctgaaggccaacctcaccggcttcaagggcaaggtggaccgcgagtccgggaacagcatcaagtacatggccacgcagcggatctactccttccacacctaccgcggcctgaagcagaagatccggaccagcgaggagggggtgaaggagaccctgctcatgcagatgatcgacgagctgagcaaggtccccaacgtggtgtaccagcacctgtccacgacccagcagaacagcttcatcgaggactggaacgagtactacaaggactacgaggacgacgtcgagaccgacgacctctcccgcgtgatccaccccgtgatccggaagcgctacgaggaccggttcaactacttcgccatccgcttcctggacgagttcttcgacttccccaccctgcggttccaggtccacctcggcgactacgtgcacgaccgccgcacgaagcagctggggaaggtggagagcgaccggatcatcaaggagaaggtcaccgtgttcgcccgcctgaaggacatcaactccgcgaaggccagctacttccactccctcgaggagcaggacaaggaggagctggacaacaagtggaccctgttcccgaaccccagctacgacttccccaaggagcacaccctccagcaccagggcgagcagaagaacgccggcaagatcgggatctacgtcaagctgcgggacacgcagtacaaggagaaggccgccctggaggaggcgcgcaagtccctcaaccccaaggagcggagcgccaccaaggcctccaagtacgacatcatcacccagatcatcgaggccaacgacaacgtcaagagcgagaagccgctggtgttcaccggccagcccatcgcctacctgtccatgaacgacatccacagcatgctgttctccctgctgacggacaacgcggagctcaagaagacccccgaggaggtggaggccaagctgatcgaccagatcgggaagcagatcaacgagatcctgagcaaggacaccgacaccaagatcctgaagaagtacaaggacaacgacctcaaggagacggacaccgacaagatcacccgcgacctggcccgggacaaggaggagatcgagaagctgatcctcgagcagaagcagcgcgccgacgactacaactacacctccagcaccaagttcaacatcgacaagtcccggaagcgcaagcacctcctgttcaacgcggagaagggcaagatcggcgtgtggctcgccaacgacatcaagcggttcatgttcaaggagagcaagagcaagtggaaggggtaccagcacacggagctgcagaagctgttcgcctacttcgacacctccaagagcgacctcgagctgatcctgtccgacatggtgatggtcaaggactaccccatcgagctcatcgacctggtgcgcaagagccggaccctggtggacttcctcaacaagtacctggaggcccgcctgggctacatcgagaacgtcatcacccgggtgaagaactccatcgggacgccgcagttcaagaccgtgcgcaaggagtgcttcgccttcctcaaggagagcaactacaccgtcgcgtccctggacaagcagatcgagcggatcctgagcatgcccctcttcatcgagcgcggcttcatggactccaagcccaccatgctggagggcaagagctaccagcagcacaaggaggacttcgccgactggttcgtgcactacaaggagaactccaactaccagaacttctacgacacggaggtgtacgagatcatcaccgaggacaagcgggagcaggccaaggtcaccaagaagatcaagcagcagcagaagaacgacgtgttcaccctgatgatggtgaactacatgctcgaggaggtcctgaagctgcccagcaacgaccgcctctccctgaacgagctgtaccagacgaaggaggagcgcatcgtgaacaagcaggtcgccaaggacacccaggagcggaacaagaactacatctggaacaaggtggtggacctccagctgtgcgaggggctggtgcgcatcgacaaggtcaagctcaaggacatcggcaacttccggaagtacgagaacgacagccgcgtgaaggagttcctgacctaccagtccgacatcgtgtggagcgggtacctgtccaacgaggtcgacagcaacaagctctacgtgatcgagcggcagctggacaactacgagagcatccgctccaaggagctgctcaaggaggtgcaggagatcgagtgcatcgtctacaaccaggtggccaacaaggagagcctgaagcagtccggcaacgagaacttcaagcagtacgtgctgcaggggctcctgccgcggggcaccgacgtccgcgagatgctgatcctcagcacggacgtgaagttcaagaaggaggagatcatgcagctggggcaggtccgggaggtggagcaggacctgtactccctcatctacatccgcaacaagttcgcgcacaaccagctgcccatcaaggagttcttcgacttctgcgagaacaactaccggcccatcagcgacaacgagtactacgccgagtactacatggagatcttccgctccatcaaggagaagtacgccagctga

SEQ ID NO: 11186 - RNA, 3480 nt, synthetic construct
  misc_feature 1..3480: note = Cas13b variant__Myroides odoratimimus__WP_058700060.1__Cas13b
  source 1..3480: mol_type = other RNA
atgaaggacatcctgaccaccgacacgaccgagaagcagaaccgcttctacagccacaagatcgccgacaagtacttcttcggcgggtacttcaacctcgcctccaacaacatctacgaggtgttcgaggaggtcaacaagcggaacaccttcggcaagctggcgaagcgcgacaacgggaacctgaagaactacatcatccacgtgttcaaggacgagctcagcatctccgacttcgagaagcgggtggccatcttcgccagctacttccccatcctggagaccgtcgacaagaagtccatcaaggagcgcaaccggacgatcgacctgaccctcagccagcgcatccggcagttccgcgagatgctgatctccctggtgaccgccgtggaccagctccggaacttctacacccactaccaccacagcgacatcgtcatcgagaacaaggtgctggacttcctgaactccagcttcgtgtccacggccctccacgtcaaggacaagtacctgaagaccgacaagaccaaggagttcctgaaggagaccatcgcggccgagctcgacatcctgatcgaggcctacaagaagaagcagatcgagaagaagaacacgcgcttcaaggccaacaagcgggaggacatcctgaacgcgatctacaacgaggccttctggagcttcatcaacgacaaggacaaggacaaggacaaggagaccgtggtggccaagggcgccgacgcctacttcgagaagaaccaccacaagtccaacgacccggacttcgcgctcaacatcagcgagaaggggatcgtctacctgctgtccttcttcctcaccaacaaggagatggacagcctgaaggccaacctgaccggcttcaagggcaaggtggaccgcgagtccgggaacagcatcaagtacatggccacgcagcggatctactccttccacacctaccgcggcctcaagcagaagatccggaccagcgaggagggggtgaaggagaccctgctgatgcagatgatcgacgagctcagcaaggtccccaacgtggtgtaccagcacctgtccacgacccagcagaacagcttcatcgaggactggaacgagtactacaaggactacgaggacgacgtcgagaccgacgacctgtcccgcgtgacccaccccgtgatccggaagcgctacgaggaccggttcaactacttcgccatccgcttcctcgacgagttcttcgacttccccacgctgcggttccaggtccacctgggcgactacgtgcacgaccgccgcaccaagcagctcgggaaggtggagagcgaccggatcatcaaggagaaggtcaccgtgttcgcccgcctgaaggacatcaactccgcgaaggccagctacttccactccctggaggagcaggacaaggaggagctcgacaacaagtggaccctgttcccgaaccccagctacgacttccccaaggagcacacgctgcagcaccagggcgagcagaagaacgccggcaagatcgggatctacgtcaagctccgggacacccagtacaaggagaaggccgccctggaggaggcgcgcaagtccctgaaccccaaggagcggagcgccaccaaggcctccaagtacgacatcatcacccagatcatcgaggccaacgacaacgtcaagagcgagaagccgctcgtgttcacgggccagcccatcgcctacctgtccatgaacgacatccacagcatgctgttctccctcctgaccgacaacgcggagctgaagaagacccccgaggaggtggaggccaagctcatcgaccagatcgggaagcagatcaacgagatcctgagcaaggacaccgacacgaagatcctgaagaagtacaaggacaacgacctgaaggagaccgacaccgacaagatcacccgcgacctcgcccgggacaaggaggagatcgagaagctgatcctggagcagaagcagcgcgccgacgactacaactacacctccagcacgaagttcaacatcgacaagtcccggaagcgcaagcacctcctgttcaacgcggagaagggcaagatcggcgtgtggctggccaacgacatcaagcggttcatgttcaaggagagcaagagcaagtggaaggggtaccagcacatcgagctccagaagctgttcgcctacttcgacacctccaagagcgacctggagctcatcctgtccaacatggtgatggtcaaggactaccccatcgagctgatcgacctcgtgaagaagtcccgcaccctggtggacttcctgaacaagtacctcgaggcccggctggagtacatcgagaacgtcatcacccgcgtgaagaacagcatcggcacgccgcagttcaagaccgtgcggaaggagtgcttcaccttcctgaagaagtccaactacaccgtcgtgagcctcgacaagcaggtcgagcgcatcctgagcatgcccctgttcatcgagcgggggttcatggacgacaagcccacgatgctcgagggcaagtcctacaagcagcacaaggagaagttcgccgactggttcgtgcactacaaggagaacagcaactaccagaacttctacgacaccgaggtgtacgagatcaccaccgaggacaagcgcgagaaggcgaaggtgacgaagaagatcaagcagcagcagaagaacgacgtcttcaccctgatgatggtgaactacatgctggaggaggtgctcaagctgtccagcaacgaccggctgtccctcaacgagctgtaccagaccaaggaggagcgcatcgtcaacaagcaggtcgccaaggacacccaggagcgcaacaagaactacatctggaacaaggtggtggacctgcagctctgcgacgggctggtgcacatcgacaacgtgaagctgaaggacatcggcaacttccggaagtacgagaacgacagccgcgtcaaggagttcctcacgtaccagtccgacatcgtgtggagcgcctacctgtccaacgaggtggacagcaacaagctgtacgtcatcgagcggcagctcgacaactacgagagcatccgctccaaggagctgctgaaggaggtgcaggagatcgagtgcagcgtgtacaaccaggtcgccaacaaggagtccctcaagcagagcggcaacgagaacttcaagcagtacgtgctgcaggggctgctccccatcggcatggacgtgcgggagatgctgatcctgtccaccgacgtcaagttcaagaaggaggagatcatccagctcgggcaggccggcgaggtggagcaggacctgtacagcctgatctacatccgcaacaagttcgcgcacaaccagctcccgatcaaggagttcttcgacttctgcgagaacaactaccggtccatcagcgacaacgagtactacgccgagtactacatggagatcttccgctccatcaaggagaagtacgccaactga

SEQ ID NO: 11187 - RNA, 3465 nt, synthetic construct
  misc_feature 1..3465: note = Cas13b variant__Paludibacter propionicigenes__WP_013446107.1__Cas13b
  source 1..3465: mol_type = other RNA
atgaagaccagcgccaacaacatctacttcaacggcatcaactccttcaagaagatcttcgacagcaagggggccatcgcgcccatcgccgagaagtcctgccgcaacttcgacatcaaggcccagaacgacgtgaacaaggagcagcggatccactacttcgccgtcggccacaccttcaagcagctggacacggagaacctcttcgagtacgtgctggacgagaacctgcgcgccaagcggccgacccgcttcatcagcctccagcagttcgacaaggagttcatcgagaacatcaagcggctgatctccgacatccgcaacatcaacagccactacatccaccggttcgaccccctgaagatcgacgcggtgcccaccaacatcatcgacttcctcaaggagtccttcgagctggccgtcatccagatctacctgaaggagaaggggatcaactacctccagttcagcgagaacccccacgccgaccagaagctggtggccttcctgcacgacaagttcctcccgctggacgagaagaagacctccatgctgcagaacgagacgccccagctcaaggagtacaaggagtaccgcaagtacttcaagaccctgagcaagcaggcggccatcgaccagctgctgttcgccgagaaggagaccgactacatctggaacctgttcgactcccaccccgtgctgaccatcagcgccggcaagtacctctccttctacagctgcctgttcctgctctccatgttcctgtacaagagcgaggccaaccagctgatctccaagatcaaggggttcaagaagaacacgaccgaggaggagaagtccaagcgggagatcttcaccttcttcagcaagcgcttcaacagcatggacatcgacagcgaggagaaccagctcgtcaagttccgggacctgatcctgtacctcaaccactaccccgtggcgtggaacaaggacctggagctggactccagcaacccggccatgaccgacaagctcaagtccaagatcatcgagctggagatcaaccgcagcttccccctgtacgagggcaacgagcggttcgccacgttcgccaagtaccagatctggggcaagaagcacctcgggaagtccatcgagaaggagtacatcaacgccagcttcaccgacgaggagatcaccgcgtacacctacgagacggacacgtgccccgagctgaaggacgcccacaagaagctggccgacctcaaggccgccaagggcctgttcgggaagcgcaaggagaagaacgagtccgacatcaagaagaccgagaccagcatccgggagctgcagcacgagcccaacccgatcaaggacaagctcatccagcgcatcgagaagaacctgctgaccgtgtcctacggccggaaccaggaccgcttcatggacttcagcgcgcggttcctcgccgagatcaactacttcgggcaggacgcctccttcaagatgtaccacttctacgccaccgacgagcagaacagcgagctggagaagtacgagctgcccaaggacaagaagaagtacgactccctcaagttccaccagggcaagctggtccacttcatcagctacaaggagcacctgaagcgctacgagtcctgggacgacgccttcgtgatcgagaacaacgcgatccagctgaagctcagcttcgacggcgtggagaacaccgtcaccatccagcgggccctgctgatctacctcctggaggacgccctgcgcaacatccagaacaacacggccgagaacgcggggaagcagctcctgcaggagtactactcccacaacaaggccgacctgagcgccttcaagcagatcctcacccagcaggactccatcgagccccagcagaagaccgagttcaagaagctgctgccccgccggctcctgaacaactacagcccggccatcaaccacctccagacgccccacagctccctccccctgatcctggagaaggccctcctggcggagaagcgctactgcagcctggtggtgaaggccaaggccgagggcaactacgacgacttcatcaagcggaacaaggggaagcagttcaagctccagttcatccgcaaggcctggaacctgatgtacttccggaactcctacctgcagaacgtccaggccgcgggccaccacaagagcttccacatcgagcgcgacgagttcaacgacttctcccggtacatgttcgccttcgaggagctcagccagtacaagtactacctgaacgagatgttcgagaagaagggcttcttcgagaacaacgagttcaagatcctgttccagtccgggaccagcctcgagaacctgtacgagaagaccaagcagaagttcgagatctggctggcctccaacaccgccaagaccaacaagcccgacaactaccacctcaacaactacgagcagcagttcagcaaccagctgttcttcatcaacctgtcccacttcatcaactacctcaagagcacgggcaagctgcagaccgacgccaacgggcagatcatctacgaggcgctgaacaacgtgcagtacctcatcccggagtactactacaccgacaagcccgagcgctccgagagcaagtccggcaacaagctgtacaacaagctgaaggccaccaagctcgaggacgccctgctgtacgagatggccatgtgctacctcaaggcggacaagcagatcgccgacaaggccaagcaccccatcacgaagctgctgaccagcgacgtggagttcaacatcaccaacaaggaggggatccagctctaccacctcctggtccccttcaagaagatcgacgccttcatcggcctgaagatgcacaaggagcagcaggacaagaagcacccgacctccttcctggccaacatcgtgaactacctggagctcgtgaagaacgacaaggacatccggaagacctacgaggcgttcagcacgaaccccgtcaagcgcaccctgacctacgacgacctggccaagatcgacggccacctcatcagcaagtccatcaagttcaccaacgtgacgctggagctggagcggtacttcatcttcaaggagagcctcatcgtgaagaaggggaacaacatcgacttcaagtacatcaagggcctgcgcaactactacaacaacgagaagaagaagaacgaggggatccggaacaaggccttccacttcggcatccccgactccaagagctacgaccagctgatccgcgacgccgaggtcatgttcatcgccaacgaggtgaagcccacccacgcgaccaagtacaccgacctcaacaagcagctgcacacggtctgcgacaagctgatggagaccgtgcacaacgactacttctccaaggagggggacggcaagaagaagcgggaggccgccggccagaagtacttcgagaacatcatcagcgccaagtga

SEQ ID NO: 11188 - RNA, 3396 nt, synthetic construct
  misc_feature 1..3396: note = Cas13b variant__Phaeodactylibacter xiamenensis__WP_044218239.1__Cas13b
  source 1..3396: mol_type = other RNA
atgaccaacacccccaagcgccggacgctgcaccgccacccgagctacttcggcgccttcctcaacatcgcccggcacaacgcgttcatgatcatggagcacctgtccaccaagtacgacatggaggacaagaacaccctggacgaggcccagctccccaacgccaagctgttcgggtgcctgaagaagcgctacggcaagcccgacgtgaccgagggggtcagccgggacctccgccggtacttccccttcctgaactacccgctgttcctccacctggagaagcagcagaacgccgagcaggccgcgacgtacgacatcaaccccgaggacatcgagttcaccctgaagggcttcttccgcctcctgaaccagatgcggaacaactactcccactacatcagcaacaccgactacgggaagttcgacaagctgcccgtgcaggacatctacgaggccgccatcttccgcctcctggaccggggcaagcacaccaagcgcttcgacgtgttcgagtccaagcacacgcggcacctggagagcaacaactccgagtaccgcccccggagcctcgccaactccccggaccacgagaacaccgtcgcgttcgtgacctgcctgttcctggagcgcaagtacgccttccccttcctcagccggctggactgcttccgctccaccaacgacgccgccgagggcgaccccctgatccggaaggccagccacgagtgctacacgatgttctgctgccgcctcccccagccgaagctggagtccagcgacatcctgctcgacatggtgaacgagctggggcggtgcccctccgcgctgtacaacctcctgagcgaggaggaccaggcccgcttccacatcaagcgcgaggagatcaccggcttcgaggaggaccccgacgaggagctggagcaggagatcgtcctcaagcggcactccgaccgcttcccctacttcgccctgcggtacttcgacgacaccgaggccttccagaccctgcgcttcgacgtgtacctcgggcggtggcgcacgaagccggtgtacaagaagcggatctacggccaggagcgcgaccgggtcctgacccagagcatccgcaccttcacccggctgtcccgcctcctgcccatctacgagaacgtgaagcacgacgccgtgcggcagaacgaggaggacgggaagctggtcaaccccgacgtgacgagccagttccacaagagctggatccagatcgagtccgacgaccgcgcgttcctcagcgaccggatcgagcacttcagcccccactacaacttcggcgaccaggtgatcggcctgaagttcatcaacccggaccgctacgccgccatccagaacgtcttccccaagctgcccggggaggagaagaaggacaaggacgccaagctcgtgaacgagaccgccgacgcgatcatctccacccacgagatccggtccctgttcctgtaccactacctcagcaagaagcccatctccgccggcgacgagcgccggttcatccaggtggacaccgagacgttcatcaagcagtacatcgacaccatcaagctgttcttcgaggacatcaagagcggggagctgcagccgatcgccgacccgcccaactaccagaagaacgagcccctgccctacgtccgcggcgacaaggagaagacccaggaggagcgcgcccagtaccgggagcgccagaaggagatcaaggagcggcgcaaggagctcaacaccctgctgcagaaccggtacggcctctccatccagtacatccccagccgcctgcgggagtacctgctcgggtacaagaaggtgccctacgagaagctggccctgcagaagctccgcgcgcagcggaaggaggtgaagaagcgcatcaaggacatcgagaagatgcggacgccgcgcgtcggcgagcaggccacctggctggccgaggacatcgtgttcctgaccccgcccaagatgcacacccccgagcggaagacgaccaagcacccccagaagctcaacaacgaccagttccgcatcatgcagtccagcctggcctacttctccgtgaacaagaaggcgatcaagaagttcttccagaaggagaccgggatcggcctgagcaaccgggagacctcccaccccttcctctaccgcatcgacgtcgggcggtgccgcggcatcctggacttctacacgggctacctgaagtacaagatggactggctcgacgacgccatcaagaaggtggacaaccggaagcacgggaagaaggaggccaagaagtacgagaagtacctgcccagctccatccagcacaagacgcccctggagctcgactacacccgcctgccggtctacctgccccggggcctcttcaagaaggccatcgtgaaggccctggcggcccacgccgacttccaggtggagcccgaggaggacaacgtcatcttctgcctggaccagctcctggacggggacacccaggacttctacaactggcagcgctactaccgcagcgccctgaccgagaaggagaccgacaaccagctcgtgctggcccacccctacgcggagcagatcctgggcaccatcaagaccctcgaggggaagcagaagaacaacaagctgggcaacaaggccaagcagaagatcaaggacgagctgatcgacctcaagcgggccaagcgccggctgctggaccgcgagcagtacctccgggccgtgcaggccgaggaccgcgcgctgtggctgatgatccaggagcggcagaagcagaaggccgagcacgaggagatcgccttcgaccagctcgacctgaagaacatcaccaagatcctgacggagtccatcgacgcccgcctccggatcccggacaccaaggtcgacatcaccgacaagctgcccctgcgccggtacggcgacctccgccgggtggcgaaggaccgccggctggtgaacctggccagctactaccacgtcgccgggctcagcgagatcccctacgacctggtgaagaaggagctggaggagtacgaccgccggcgcgtggccttcttcgagcacgtctaccagttcgagaaggaggtgtacgaccggtacgccgcggagctccgcaacgagaaccccaagggcgagtccacctacttcagccactgggagtacgtggccgtcgccgtgaagcactccgccgacacgcacttcaacgagctgttcaaggagaaggtgatgcagctgcgcaacaagttccaccacaacgagttcccgtacttcgactggctcctgcccgaggtcgagaaggccagcgcggccctgtacgccgaccgggtgttcgacgtggccgaggggtactaccagaagatgcgcaagctcatgcggcagtga

SEQ ID NO: 11189 - RNA, 3408 nt, synthetic construct
  misc_feature 1..3408: note = Cas13b variant__Porohyromonas gingivalis__WP_012458151.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgtgttcttcaagcccgacgacttcgtgctggccaagaaccgcaaggagcagctgatctccgtcgcggacgggaaggagtgcctcaccgtgagcggcttcgccttcttcatctgcctgttcctggaccgggagcaggcctccgggatgctcagccgcatccggggcttcaagcgcaccgacgagaactgggcccgggcggtgcacgagacgttctgcgacctgtgcatccgccacccccacgaccggctggagagctccaacaccaaggaggccctcctgctggacatgctcaacgagctgaaccgctgcccccggatcctgtacgacatgctcccggaggaggagcgcgcccagttcctgcccgccctggacgagaacagcatgaacaacctctccgagaacagcctggacgaggagtcccgcctgctctgggacgggagctccgactgggccgaggcgctgaccaagcggatccgccaccaggaccggttcccctacctgatgctccgcttcatcgaggagatggacctgctgaagggcatccggttccgcgtcgacctcggcgagatcgagctggacagctactccaagaaggtggggcggaacggcgagtacgaccgcaccatcacggaccacgccctggccttcgggaagctcagcgacttccagaacgaggaggaggtgtcccggatgatcagcggcgaggcctcctaccccgtccgcttcagcctgttcgccccgcggtacgcgatctacgacaacaagatcggctactgccacacctccgaccccgtgtaccccaagagcaagaccggggagaagcgcgccctgtccaacccccagagcatgggcttcatctccgtgcacgacctgcggaagctcctgctgatggagctcctgtgcgaggggagcttcagccgcatgcagtccgacttcctgcggaaggccaaccgcatcctcgacgagaccgccgagggcaagctgcagttcagcgccctgttcccggagatgcggcaccgcttcatcccgccccagaaccccaagtccaaggaccggcgcgagaaggcggagacgaccctcgagaagtacaagcaggagatcaaggggcgcaaggacaagctgaacagccagctgctctccgccttcgacatggaccagcggcagctgcccagccgcctgctcgacgagtggatgaacatccggcccgcctcccacagcgtcaagctgcgcacctacgtgaagcagctgaacgaggactgccggctccgcctgcggaagttccgcaaggacggcgacggcaaggcccgggccatccccctggtgggggagatggcgaccttcctctcccaggacatcgtccgcatgatcatcagcgaggagacgaagaagctgatcacctccgcctactacaacgagatgcagcggagcctggcccagtacgccggcgaggagaaccgccggcagttccgcgcgatcgtggccgagctccggctgctggacccctccagcgggcacccgttcctctccgccaccatggagaccgcccaccgctacacggagggcttctacaagtgctacctggagaagaagcgggagtggctggccaagatcttctaccgccccgagcaggacgagaacaccaagcggcgcatcagcgtgttcttcgtccccgacggggaggcgcggaagctcctgcccctgctcatccgccgccggatgaaggagcagaacgacctgcaggactggatccgcaacaagcaggcccacccgatcgacctgccctcccacctcttcgacagcaaggtgatggagctgctgaaggtcaaggacggcaagaagaagtggaacgaggccttcaaggactggtggagcaccaagtaccccgacggcatgcagccgttctacgggctccggcgcgagctgaacatccacggcaagtccgtgagctacatcccctccgacgggaagaagttcgccgactgctacacccacctgatggagaagacggtgcgggacaagaagcgcgagctccggaccgccggcaagcccgtgcccccggacctggcggccgacatcaagcgcagcttccaccgggccgtcaacgagcgcgagttcatgctgcggctcgtgcaggaggacgaccgcctgatgctgatggccatcaacaagatgatgaccgaccgggaggaggacatcctccccgggctgaagaacatcgactccatcctggacgaggagaaccagttcagcctcgccgtccacgcgaaggtgctggagaaggagggcgagggcggggacaactccctgagcctcgtgcccgccaccatcgagatcaagtccaagcgcaaggactggagcaagtacatccggtaccgctacgaccggcgcgtccccggcctgatgtcccacttcccggagcacaaggccacgctggacgaggtgaagaccctcctgggggagtacgaccggtgccgcatcaagatcttcgactgggccttcgcgctggagggcgccatcatgagcgaccgcgacctcaagccctacctgcacgagtccagctcccgggagggcaagagcggggagcactccaccctggtgaagatgctcgtcgagaagaagggctgcctgacccccgacgagagccagtacctgatcctcatccgcaacaaggccgcccacaaccagttcccctgcgccgcggagatgccgctgatctaccgggacgtgtccgccaaggtggggagcatcgagggcagctccgccaaggacctgcccgaggggagctccctcgtcgacagcctgtggaagaagtacgagatgatcatccgcaagatcctgcccatcctcgaccccgagaaccggttcttcggcaagctgctgaacaacatgtcccagccgatcaacgacctctga

SEQ ID NO: 11190 - RNA, 3408 nt, synthetic construct
  misc_feature 1..3408: note = Cas13b variant__Porohyromonas gingivalis__ERJ81987.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgacttcttcaagcccgacgacttcgtgctggccaagaaccgcaaggagcagctgatctccgtggcggacgggaaggagtgcctcaccgtcagcggcctggccttcttcatctgcctgttcctcgaccgggagcaggcctccgggatgctgagccgcatccggggcttcaagcgcaccgacgagaactgggcccgggcggtgcacgagacgttctgcgacctgtgcatccgccacccccacgaccggctcgagagctccaacaccaaggaggccctgctgctcgacatgctgaacgagctgaaccgctgcccccggatcctctacgacatgctgccggaggaggagcgcgcccagttcctgcccgccctcgacgagaacagcatgaacaacctgtccgagaacagcctgaacgaggagtcccgcctcctgtgggacgggagctccgactgggccgaggcgctgaccaagcggatccgccaccaggaccggttcccctacctcatgctgcgcttcatcgaggagatggacctgctcaagggcatccggttccgcgtggacctgggcgagatcgagctggacagctactccaagaaggtcgggcggaacggcgagtacgaccgcaccatcacggaccacgccctcgccttcgggaagctgagcgacttccagaacgaggaggaggtgtcccggatgatcagcggcgaggcctcctaccccgtgcgcttcagcctgttcgccccgcggtacgcgatctacgacaacaagatcggctactgccacacctccgaccccgtctaccccaagagcaagaccggggagaagcgcgccctgtccaacccccagagcatgggcttcatctccgtgcacgacctccggaagctgctgctcatggagctgctgtgcgaggggagcttcagccgcatgcagtccggcttcctccggaaggccaaccgcatcctggacgagaccgccgaggggaagctgcagttcagcgccctcttcccggagatgcggcaccgcttcatcccgccccagaaccccaagtccaaggaccggcgcgagaaggcggagacgaccctggagaagtacaagcaggagatcaagggccgcaaggacaagctgaacagccagctcctgtccgccttcgacatgaaccagcggcagctgcccagccgcctcctggacgagtggatgaacatccggcccgcctcccacagcgtgaagctgcgcacctacgtcaagcagctcaacgaggactgccggctgcgcctgcggaagttccgcaaggacggcgacgggaaggcccgggccatccccctcgtgggcgagatggcgaccttcctgtcccaggacatcgtgcgcatgatcatcagcgaggagacgaagaagctgatcacctccgcctactacaacgagatgcagcggagcctcgcccagtacgccggggaggagaaccgccggcagttccgcgcgatcgtcgccgagctgcacctcctggacccctccagcggccacccgttcctgtccgccaccatggagaccgcccaccggtacacggaggacttctacaagtgctacctggagaagaagcgcgagtggctcgccaagaccttctaccggcccgagcaggacgagaacaccaagcgccggatcagcgtgttcttcgtgcccgacggggaggcgcgcaagctgctgcccctcctgatccggcgccgcatgaaggagcagaacgacctgcaggactggatccggaacaagcaggcccacccgatcgacctcccctcccacctgttcgacagcaagatcatggagctgctcaaggtcaaggacggcaagaagaagtggaacgaggccttcaaggactggtggagcaccaagtaccccgacggcatgcagccgttctacgggctgcgccgggagctgaacatccacggcaagtccgtgagctacatcccctccgacgggaagaagttcgccgactgctacacgcacctcatggagaagaccgtccaggacaagaagcgcgagctgcggaccgccggcaagcccgtgcccccggacctggcggccgacatcaagcgcagcttccaccgggccgtgaacgagcgcgagttcatgctccggctggtccaggaggacgaccgcctgatgctcatggccatcaacaagatgatgaccgaccgggaggaggacatcctgcccgggctgaagaacatcgactccatcctcgacgaggagaaccagttcagcctggccgtgcacgcgaaggtgctggagaaggagggcgagggcggggacaactccctcagcctggtccccgccacgatcgagatcaagtccaagcgcaaggactggagcaagtacatccggtaccgctacgaccggcgcgtgcccggcctgatgtcccacttcccggagcacaaggccaccctcgacgaggtgaagaccctgctgggggagtacgaccggtgccgcatcaagatcttcgactgggccttcgcgctcgagggcgccatcatgagcgaccgggacctgaagccctacctgcacgagtccagctcccgcgagggcaagagcggggagcactccaccctcgtcaagatgctggtggagaagaagggctgcctgacgcccgacgagagccagtacctcatcctgatccgcaacaaggccgcccacaaccagttcccctgcgccgcggagatgccgctgatctaccgggacgtgtccgccaaggtcgggagcatcgagggcagctccgccaaggacctccccgaggggagctccctggtggacagcctgtggaagaagtacgagatgatcatccgcaagatcctccccatcctggaccacgagaaccggttcttcggcaagctgctcaacaacatgtcccagcccatcaacgacctgtga

SEQ ID NO: 11191 - RNA, 3408 nt, synthetic construct
  misc_feature 1..3408: note = Cas13b variant__Porohyromonas gingivalis__ERJ65637.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgacttcttcaagcccgacgacttcgtgctggccaagaaccgcaaggagcagctgatctccgtggcggacgggaaggagtgcctcaccgtcagcggcctggccttcttcatctgcctgttcctcgaccgggagcaggcctccgggatgctgagccgcatccggggcttcaagcgcaccgacgagaactgggcccgggcggtgcacgagacgttctgcgacctgtgcatccgccacccccacgaccggctcgagagctccaacaccaaggaggccctgctgctcgacatgctgaacgagctgaaccgctgcccccggatcctctacgacatgctgccggaggaggagcgcgcccagttcctgcccgccctcgacgagaacagcatgaacaacctgtccgagaacagcctgaacgaggagtcccgcctcctgtgggacgggagctccgactgggccgaggcgctgaccaagcggatccgccaccaggaccggttcccctacctcatgctgcgcttcatcgaggagatggacctgctcaagggcatccggttccgcgtggacctgggcgagatcgagctggacagctactccaagaaggtcgggcggaacggcgagtacgaccgcaccatcacggaccacgccctcgccttcgggaagctgagcgacttccagaacgaggaggaggtgtcccggatgatcagcggcgaggcctcctaccccgtgcgcttcagcctgttcgccccgcggtacgcgatctacgacaacaagatcggctactgccacacctccgaccccgtctaccccaagagcaagaccggggagaagcgcgccctgtccaacccccggagcatgggcttcatctccgtgcacgacctccgcaagctgctgctcatggagctgctgtgcgaggggagcttcagccggatgcagtccgacttcctccgcaaggccaaccggatcctggacgagaccgccgagggcaagctgcagttcagcgccctcttcccggagatgcgccaccggttcatcccgccccagaaccccaagtccaaggaccgccgcgagaaggcggagacgaccctggagaagtacaagcaggagatcaaggggcggaaggacaagctgaacagccagctcctgtccgccttcgacatggaccagcgccagctgcccagccggctcctggacgagtggatgaacatccgccccgcctcccacagcgtgaagctgcggacctacgtcaagcagctcaacgaggactgccgcctgcggctgcagaagttccgcaaggacggcgacggcaaggcccgggccatccccctcgtgggggagatggcgaccttcctgtcccaggacatcgtgcgcatgatcatcagcgaggagacgaagaagctgatcacctccgcctactacaacgagatgcagcggagcctcgcccagtacgccggcgaggagaaccgccaccagttccgggcgatcgtcgccgagctgcgcctgctcgacccctccagcgggcacccgttcctgtccgccaccatggagaccgcccaccggtacacggaggacttctacaagtgctacctggagaagaagcgcgagtggctcgccaagaccttctaccggcccgagcaggacgagaacaccaagcgccggatcagcgtgttcttcgtgcccgacggcgaggcgcgcaagctgctgcccctcctgatccggcgccgcatgaaggagcagaacgacctgcaggactggatccggaacaagcaggcccacccgatcgacctcccctcccacctgttcgacagcaagatcatggagctgctcaaggtcaaggacgggaagaagaagtggaacgaggccttcaaggactggtggagcaccaagtaccccgacggcatgcagccgttctacggcctgcgccgggagctgaacatccacgggaagtccgtgagctacatcccctccgacggcaagaagttcgccgactgctacacgcacctcatggagaagaccgtccaggacaagaagcgcgagctgcggaccgccgggaagcccgtgcccccggacctggcggccgacatcaagcgcagcttccaccgggccgtgaacgagcgcgagttcatgctccggctggtccaggaggacgaccgcctgatgctcatggccatcaacaagatgatgaccgaccgggaggaggacatcctgcccggcctgaagaacatcgactccatcctcgacgaggagaaccagttcagcctggccgtgcacgcgaaggtgctggagaaggagggggagggcggcgacaactccctcagcctggtccccgccacgatcgagatcaagtccaagcgcaaggactggagcaagtacatccggtaccgctacgaccggcgcgtgcccgggctgatgtcccacttcccggagcacaaggccaccctcgacgaggtgaagaccctgctgggcgagtacgaccggtgccgcatcaagatcttcgactgggccttcgcgctcgagggggccatcatgagcgaccgggacctgaagccctacctgcacgagtccagctcccgcgagggcaagagcggcgagcactccaccctcgtcaagatgctggtggagaagaaggggtgcctgacgcccgacgagagccagtacctcatcctgatccgcaacaaggccgcccacaaccagttcccctgcgccgcggagatgccgctgatctaccgggacgtgtccgccaaggtcggcagcatcgaggggagctccgccaaggacctccccgagggcagctccctggtggacagcctgtggaagaagtacgagatgatcatccgcaagatcctccccatcctggaccccgagaaccggttcttcgggaagctgctcaacaacatgtcccagccgatcaacgacctgtga

SEQ ID NO: 11192 - RNA, 3408 nt, synthetic construct
  misc_feature 1..3408: note = Cas13b variant__Porohyromonas gingivalis__WP_021665475.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgacttcttcaagcccgacgacttcgtgctggccaagaaccgcaaggagcagctgatctccgtggcggacgggaaggagtgcctcaccgtcagcggcctggccttcttcatctgcctgttcctcgaccgggagcaggcctccgggatgctgagccgcatccggggcttcaagcgcaccaacgagaactgggcccgggcggtgcacgagacgttctgcgacctgtgcatccgccacccccacgaccggctcgagagctccaacaccaaggaggccctgctgctcgacatgctgaacgagctgaaccgctgcccccggatcctctacgacatgctgccggaggaggagcgcgcccagttcctgcccgccctcgacgagaacagcatgaacaacctgtccgagaacagcctgaacgaggagtcccgcctcctgtgggacgggagctccgactgggccgaggcgctgaccaagcggatccgccaccaggaccggttcccctacctcatgctgcgcttcatcgaggagatggacctgctcaagggcatccggttccgcgtggacctgggcgagatcgagctggacagctactccaagaaggtcgggcggaacggcgagtacgaccgcaccatcacggaccacgccctcgccttcgggaagctgagcgacttccagaacgaggaggaggtgtcccggatgatcagcggcgaggcctcctaccccgtgcgcttcagcctgttcgccccgcggtacgcgatctacgacaacaagatcggctactgccacacctccgaccccgtctaccccaagagcaagaccggggagaagcgcgccctgtccaacccccagagcatgggcttcatctccgtgcacgacctccggaagctgctgctcatggagctgctgtgcgaggggagcttcagccgcatgcagtccggcttcctccggaaggccaaccgcatcctggacgagaccgccgaggggaagctgcagttcagcgccctcttcccggagatgcggcaccgcttcatcccgccccagaaccccaagtccaaggaccggcgcgagaaggcggagacgaccctggagaagtacaagcaggagatcaagggccgcaaggacaagctgaacagccagctcctgtccgccttcgacatgaaccagcggcagctgcccagccgcctcctggacgagtggatgaacatccggcccgcctcccacagcgtgaagctgcgcacctacgtcaagcagctcaacgaggactgccggctgcgcctgcggaagttccgcaaggacggcgacgggaaggcccgggccatccccctcgtgggcgagatggcgaccttcctgtcccaggacatcgtgcgcatgatcatcagcgaggagacgaagaagctgatcacctccgcctactacaacgagatgcagcggagcctcgcccagtacgccggggaggagaaccgccggcagttccgcgcgatcgtcgccgagctgcacctcctggacccctccagcggccacccgttcctgtccgccaccatggagaccgcccaccggtacacggaggacttctacaagtgctacctggagaagaagcgcgagtggctcgccaagaccttctaccggcccgagcaggacgagaacaccaagcgccggatcagcgtgttcttcgtgcccgacggggaggcgcgcaagctgctgcccctcctgatccggcgccgcatgaaggagcagaacgacctgcaggactggatccggaacaagcaggcccacccgatcgacctcccctcccacctgttcgacagcaagatcatggagctgctcaaggtcaaggacggcaagaagaagtggaacgaggccttcaaggactggtggagcaccaagtaccccgacggcatgcagccgttctacgggctgcgccgggagctgaacatccacggcaagtccgtgagctacatcccctccgacgggaagaagttcgccgactgctacacgcacctcatggagaagaccgtccaggacaagaagcgcgagctgcggaccgccggcaagcccgtgcccccggacctggcggccgacatcaagcgcagcttccaccgggccgtgaacgagcgcgagttcatgctccggctggtccaggaggacgaccgcctgatgctcatggccatcaacaagatgatgaccgaccgggaggaggacatcctgcccgggctgaagaacatcgactccatcctcgacaaggagaaccagttcagcctggccgtgcacgcgaaggtgctggagaaggagggcgagggcggggacaactccctcagcctggtccccgccacgatcgagatcaagtccaagcgcaaggactggagcaagtacatccggtaccgctacgaccggcgcgtgcccggcctgatgtcccacttcccggagcacaaggccaccctcgacgaggtgaagaccctgctgggggagtacgaccggtgccgcatcaagatcttcgactgggccttcgcgctcgagggcgccatcatgagcgaccgggacctgaagccctacctgcacgagtccagctcccgcgagggcaagagcggggagcactccaccctcgtcaagatgctggtggagaagaagggctgcctgacgcccgacgagagccagtacctcatcctgatccgcaacaaggccgcccacaaccagttcccctgcgccgcggagatgccgctgatctaccgggacgtgtccgccaaggtcgggagcatcgagggcagctccgccaaggacctccccgaggggagctccctggtggacagcctgtggaagaagtacgagatgatcatccgcaagatcctccccatcctggaccacgagaaccggttcttcggcaagctgctcaacaacatgtcccagcccatcaacgacctgtga

SEQ ID NO: 11193 - RNA, 3408 nt, synthetic construct
  misc_feature 1..3408: note = Cas13b variant__Porohyromonas gingivalis__WP_061156637.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgacttcttcaagcccgacgacttcgtgctggccaagaaccgcaaggagcagctgatctccgtggcggacgggaaggagtgcctcaccgtcagcggcctggccttcttcatctgcctgttcctcgaccgggagcaggcctccgggatgctgagccgcatccggggcttcaagcgcaccgacgagaactgggcccgggcggtgcacgagacgttctgcgacctgtgcatccgccacccccacgaccggctcgagagctccaacaccaaggaggccctgctgctcgacatgctgaacgagctgaaccgctgcccccggatcctctacgacatgctgccggaggaggagcgcgcccagttcctgcccgccctcgacgagaacagcatgaacaacctgtccgagaacagcctgaacgaggagtcccgcctcctgtgggacgggagctccgactgggccgaggcgctgaccaagcggatccgccaccaggaccggttcccctacctcatgctgcgcttcatcgaggagatggacctgctcaagggcatccggttccgcgtggacctgggcgagatcgagctggacagctactccaagaaggtcgggcggaacggcgagtacgaccgcaccatcacggaccacgccctcgccttcgggaagctgagcgacttccagaacgaggaggaggtgtcccggatgatcagcggcgaggcctcctaccccgtgcgcttcagcctgttcgccccgcggtacgcgatctacgacaacaagatcggctactgccacacctccgaccccgtctaccccaagagcaagaccggggagaagcgcgccctgtccaacccccagagcatgggcttcatctccgtgcacgacctccggaagctgctgctcatggagctgctgtgcgaggggagcttcagccgcatgcagtccggcttcctccggaaggccaaccgcatcctggacgagaccgccgaggggaagctgcagttcagcgccctcttcccggagatgcggcaccgcttcatcccgccccagaaccccaagtccaaggaccggcgcgagaaggcggagacgaccctggagaagtacaagcaggagatcaagggccgcaaggacaagctgaacagccagctcctgtccgccttcgacatgaaccagcggcagctgcccagccgcctcctggacgagtggatgaacatccggcccgcctcccacagcgtgaagctgcgcacctacgtcaagcagctcaacgaggactgccggctgcgcctgcggaagttccgcaaggacggcgacgggaaggcccgggccatccccctcgtgggcgagatggcgaccttcctgtcccaggacatcgtgcgcatgatcatcagcgaggagacgaagaagctgatcacctccgcctactacaacgagatgcagcggagcctcgcccagtacgccggggaggagaaccgccggcagttccgcgcgatcgtcgccgagctgcacctcctggacccctccagcggccacccgttcctgtccgccaccatggagaccgcccaccggtacacggaggacttctacaagtgctacctggagaagaagcgcgagtggctcgccaagaccttctaccggcccgagcaggacgagaacaccaagcgccggatcagcgtgttcttcgtgcccgacggggaggcgcgcaagctgctgcccctcctgatccggcgccgcatgaaggagcagaacgacctgcaggactggatccggaacaagcaggcccacccgatcgacctcccctcccacctgttcgacagcaagatcatggagctgctcaaggtcaaggacggcaagaagaagtggaacgaggccttcaaggactggtggagcaccaagtaccccgacggcatgcagccgttctacgggctgcgccgggagctgaacatccacggcaagtccgtgagctacatcccctccgacgggaagaagttcgccgactgctacacgcacctcatggagaagaccgtccaggacaagaagcgcgagctgcggaccgccggcaagcccgtgcccccggacctggcggccgacatcaagcgcagcttccaccgggccgtgaacgagcgcgagttcatgctccggctggtccaggaggacgaccgcctgatgctcatggccatcaacaagatgatgaccgaccgggaggaggacatcctgcccgggctgaagaacatcgactccatcctcgacaaggagaaccagttcagcctggccgtgcacgcgaaggtgctggagaaggagggcgagggcggggacaactccctcagcctggtccccgccacgatcgagatcaagtccaagcgcaaggactggagcaagtacatccggtaccgctacgaccggcgcgtgcccggcctgatgtcccacttcccggagcacaaggccaccctcgacgaggtgaagaccctgctgggggagtacgaccggtgccgcatcaagatcttcgactgggccttcgcgctcgagggcgccatcatgagcgaccgggacctgaagccctacctgcacgagtccagctcccgcgagggcaagagcggggagcactccaccctcgtcaagatgctggtggagaagaagggctgcctgacgcccgacgagagccagtacctcatcctgatccgcaacaaggccgcccacaaccagttcccctgcgccgcggagatgccgctgatctaccgggacgtgtccgccaaggtcgggagcatcgagggcagctccgccaaggacctccccgaggggagctccctggtggacagcctgtggaagaagtacgagatgatcatccgcaagatcctccccatcctggaccccgagaaccggttcttcggcaagctgctcaacaacatgtcccagccgatcaacgacctgtga

SEQ ID NO: 11194 - RNA, 3408 nt, synthetic construct
  misc_feature 1..3408: note = Cas13b variant__Porohyromonas gingivalis__WP_023846767.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgacttcttcaagcccgacgacttcgtgctggccaagaaccgcaaggagcagctgatctccgtggcggacgggaaggagtgcctcaccgtcagcggcctggccttcttcatctgcctgttcctcgaccgggagcaggcctccgggatgctgagccgcatccggggcttcaagcgcaccgacgagaactgggcccgggcggtgcacgagacgttctgcgacctgtgcatccgccacccccacgaccggctcgagagctccaacaccaaggaggccctgctgctcgacatgctgaacgagctgaaccgctgcccccggatcctctacgacatgctgccggaggaggagcgcgcccagttcctgcccgccctcgacgagaacagcatgaacaacctgtccgagaacagcctgaacgaggagtcccgcctcctgtgggacgggagctccgactgggccgaggcgctgaccaagcggatccgccaccaggaccggttcccctacctcatgctgcgcttcatcgaggagatggacctgctcaagggcatccggttccgcgtggacctgggcgagatcgagctggacagctactccaagaaggtcgggcggaacggcgagtacgaccgcaccatcacggaccacgccctcgccttcgggaagctgagcgacttccagaacgaggaggaggtgtcccggatgatcagcggcgaggcctcctaccccgtgcgcttcagcctgttcgccccgcggtacgcgatctacgacaacaagatcggctactgccacacctccgaccccgtctaccccaagagcaagaccggggagaagcgcgccctgtccaacccccggagcatgggcttcatctccgtgcacgacctccgcaagctgctgctcatggagctgctgtgcgaggggagcttcagccggatgcagtccgacttcctccgcaaggccaaccggatcctggacgagaccgccgagggcaagctgcagttcagcgccctcttcccggagatgcgccaccggttcatcccgccccagaaccccaagtccaaggaccgccgcgagaaggcggagacgaccctggagaagtacaagcaggagatcaaggggcggaaggacaagctgaacagccagctcctgtccgccttcgacatgaaccagcgccagctgcccagccggctcctggacgagtggatgaacatccgccccgcctcccacagcgtgaagctgcggacctacgtcaagcagctcaacgaggactgccgcctgcggctgcgcaagttccggaaggacggcgacggcaaggcccgcgccatccccctcgtgggggagatggcgaccttcctgtcccaggacatcgtgcggatgatcatcagcgaggagacgaagaagctgatcacctccgcctactacaacgagatgcagcgcagcctcgcccagtacgccggcgaggagaaccggcgccagttccgggcgatcgtcgccgagctgcacctcctggacccctccagcgggcacccgttcctgtccgccaccatggagaccgcccaccgctacacggaggacttctacaagtgctacctggagaagaagcgggagtggctcgccaagaccttctaccgccccgagcaggacgagaacaccaagcggcgcatcagcgtgttcttcgtgcccgacggcgaggcgcggaagctgctgcccctcctgatccgccgccggatgaaggagcagaacgacctgcaggactggatccgcaacaagcaggcccacccgatcgacctcccctcccacctgttcgacagcaagatcatggagctgctcaaggtcaaggacgggaagaagaagtggaacgaggccttcaaggactggtggagcaccaagtaccccgacggcatgcagccgttctacggcctgcggcgcgagctgaacatccacgggaagtccgtgagctacatcccctccgacggcaagaagttcgccgactgctacacgcacctcatggagaagaccgtccaggacaagaagcgggagctgcgcaccgccgggaagcccgtgcccccggacctggcggccgacatcaagcggagcttccaccgcgccgtgaacgagcgggagttcatgctccgcctggtccaggaggacgaccggctgatgctcatggccatcaacaagatgatgaccgaccgcgaggaggacatcctgcccggcctgaagaacatcgactccatcctcgacgaggagaaccagttcagcctggccgtgcacgcgaaggtgctggagaaggagggggagggcggcgacaactccctcagcctggtccccgccacgatcgagatcaagtccaagcggaaggactggagcaagtacatccgctaccggtacgaccgccgggtgcccgggctgatgtcccacttcccggagcacaaggccaccctcgacgaggtgaagaccctgctgggcgagtacgaccgctgccggatcaagatcttcgactgggccttcgcgctcgagggggccatcatgagcgaccgcgacctgaagccctacctgcacgagtccagctcccgcgagggcaagagcggcgagcactccaccctcgtcaagatgctggtggagaagaaggggtgcctgacgcccgacgagagccagtacctcatcctgatccggaacaaggccgcccacaaccagttcccctgcgccgcggagatgccgctgatctaccgcgacgtgtccgccaaggtcggcagcatcgaggggagctccgccaaggacctccccgagggcagctccctggtggacagcctgtggaagaagtacgagatgatcatccggaagatcctccccatcctggaccccgagaaccgcttcttcgggaagctgctcaacaacatgtcccagccgatcaacgacctgtga

SEQ ID NO: 11195 - RNA, 3408 nt, synthetic construct
  misc_feature 1..3408: note = Cas13b variant__Porohyromonas gingivalis__ERJ87335.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgacttcttcaagcccgacgacttcgtgctggccaagaaccgcaaggagcagctgatctccgtggcggacgggaaggagtgcctcaccgtcagcggcctggccttcttcatctgcctgttcctcgaccgggagcaggcctccgggatgctgagccgcatccggggcttcaagcgcaccgacgagaactgggcccgggcggtgcacgagacgttctgcgacctgtgcatccgccacccccacgaccggctcgagagctccaacaccaaggaggccctgctgctcgacatgctgaacgagctgaaccgctgcccccggatcctctacgacatgctgccggaggaggagcgcgcccagttcctgcccgccctcgacgagaacagcatgaacaacctgtccgagaacagcctgaacgaggagtcccgcctcctgtgggacgggagctccgactgggccgaggcgctgaccaagcggatccgccaccaggaccggttcccctacctcatgctgcgcttcatcgaggagatggacctgctcaagggcatccggttccgcgtggacctgggcgagatcgagctggacagctactccaagaaggtcgggcggaacggcgagtacgaccgcaccatcacggaccacgccctcgccttcgggaagctgagcgacttccagaacgaggaggaggtgtcccggatgatcagcggcgaggcctcctaccccgtgcgcttcagcctgttcgccccgcggtacgcgatctacgacaacaagatcggctactgccacacctccgaccccgtctaccccaagagcaagaccggggagaagcgcgccctgtccaacccccggagcatgggcttcatctccgtgcacgacctccgcaagctgctgctcatggagctgctgtgcgaggggagcttcagccggatgcagtccgacttcctccgcaaggccaaccggatcctggacgagaccgccgagggcaagctgcagttcagcgccctcttcccggagatgcgccaccggttcatcccgccccagaaccccaagtccaaggaccgccgcgagaaggcggagacgaccctggagaagtacaagcaggagatcaaggggcggaaggacaagctgaacagccagctcctgtccgccttcgacatggaccagcgccagctgcccagccggctcctggacgagtggatgaacatccgccccgcctcccacagcgtgaagctgcggacctacgtcaagcagctcaacgaggactgccgcctgcggctgcagaagttccgcaaggacggcgacggcaaggcccgggccatccccctcgtgggggagatggcgaccttcctgtcccaggacatcgtgcgcatgatcatcagcgaggagacgaagaagctgatcacctccgcctactacaacgagatgcagcggagcctcgcccagtacgccggcgaggagaaccgccaccagttccgggcgatcgtcgccgagctgcgcctgctcgacccctccagcgggcacccgttcctgtccgccaccatggagaccgcccaccggtacacggaggacttctacaagtgctacctggagaagaagcgcgagtggctcgccaagaccttctaccggcccgagcaggacgagaacaccaagcgccggatcagcgtgttcttcgtgcccgacggcgaggcgcgcaagctgctgcccctcctgatccggcgccgcatgaaggagcagaacgacctgcaggactggatccggaacaagcaggcccacccgatcgacctcccctcccacctgttcgacagcaaggtcatggagctgctcaaggtgaaggacgggaagaagaagtggaacgaggccttcaaggactggtggagcaccaagtaccccgacggcatgcagccgttctacggcctgcgccgggagctgaacatccacgggaagtccgtcagctacatcccctccgacggcaagaagttcgccgactgctacacgcacctcatggagaagaccgtgcgcgacaagaagcgggagctgcgcaccgccgggaagcccgtgcccccggacctggcggcctacatcaagcggagcttccaccgcgccgtcaacgagcgggagttcatgctccgcctggtgcaggaggacgaccggctgatgctcatggccatcaacaagatcatgaccgaccgcgaggaggacatcctgcccggcctgaagaacatcgactccatcctcgacaaggagaaccagttcagcctggccgtgcacgcgaaggtcctggagaaggagggggagggcggcgacaactccctcagcctggtgcccgccacgatcgagatcaagtccaagcggaaggactggagcaagtacatccgctaccggtacgaccgccgggtgcccgggctgatgtcccacttcccggagcacaaggccaccctcgacgaggtcaagaccctgctgggcgagtacgaccgctgccggatcaagatcttcgactgggccttcgcgctcgagggggccatcatgagcgaccgcgacctgaagccctacctgcacgagtccagctcccgcgagggcaagagcggcgagcactccaccctcgtgaagatgctggtggagaagaaggggtgcctgacgcccgacgagagccagtacctcatcctgatccggaacaaggccgcccacaaccagttcccctgcgccgcggagatcccgctgatctaccgcgacgtctccgccaaggtgggcagcatcgaggggagctccgccaaggacctccccgagggcagctccctggtggacagcctgtggaagaagtacgagatgatcatccggaagatcctccccatcctggaccccgagaaccgcttcttcgggaagctgctcaacaacatgtcccagccgatcaacgacctgtga

SEQ ID NO: 11196 - RNA, 3408 nt, synthetic construct
  misc_feature 1..3408: note = Cas13b variant__Porohyromonas gingivalis__WP_005873511.1__Cas13b
  source 1..3408: mol_type = other RNA
atgaacaccgtgcccgccagcgagaacaagggccagtcccgcaccgtcgaggacgacccgcagtacttcgggctgtacctcaacctggcccgggagaacctgatcgaggtggagagccacgtgcgcatcaagttcggcaagaagaagctcaacgaggagtccctgaagcagagcctgctctgcgaccacctcctgtccgtcgaccggtggacgaaggtgtacgggcacagccgccggtacctgcccttcctgcactacttcgaccccgactcccagatcgagaaggaccacgacagcaagaccggcgtggaccccgactccgcgcagcgcctgatccgggagctctacagcctgctggacttcctccgcaacgacttctcccacaaccggctggacgggaccaccttcgagcacctggaggtcagcccggacatctccagcttcatcacgggcacctactccctcgcctgcggccgcgcccagagccggttcgccgacttcttcaagcccgacgacttcgtgctggccaagaaccgcaaggagcagctgatctccgtggcggacgggaaggagtgcctcaccgtcagcggcctggccttcttcatctgcctgttcctcgaccgggagcaggcctccgggatgctgagccgcatccggggcttcaagcgcaccgacgagaactgggcccgggcggtgcacgagacgttctgcgacctgtgcatccgccacccccacgaccggctcgagagctccaacaccaaggaggccctgctgctcgacatgctgaacgagctgaaccgctgcccccggatcctctacgacatgctgccggaggaggagcgcgcccagttcctgcccgccctcgacgagaacagcatgaacaacctgtccgagaacagcctgaacgaggagtcccgcctcctgtgggacgggagctccgactgggccgaggcgctgaccaagcggatccgccaccaggaccggttcccctacctcatgctgcgcttcatcgaggagatggacctgctcaagggcatccggttccgcgtggacctgggcgagatcgagctggacagctactccaagaaggtcgggcggaacggcgagtacgaccgcaccatcacggaccacgccctcgccttcgggaagctgagcgacttccagaacgaggaggaggtgtcccggatgatcagcggcgaggcctcctaccccgtgcgcttcagcctgttcgccccgcggtacgcgatctacgacaacaagatcggctactgccacacctccgaccccgtctaccccaagagcaagaccggggagaagcgcgccctgtccaacccccagagcatgggcttcatctccgtgcacaacctccggaagctgctgctcatggagctgctgtgcgaggggagcttcagccgcatgcagtccgacttcctccggaaggccaaccgcatcctggacgagaccgccgagggcaagctgcagttcagcgccctcttcccggagatgcggcaccgcttcatcccgccccagaaccccaagtccaaggaccggcgcgagaaggcggagacgaccctggagaagtacaagcaggagatcaaggggcgcaaggacaagctgaacagccagctcctgtccgccttcgacatgaaccagcggcagctgcccagccgcctcctggacgagtggatgaacatccggcccgcctcccacagcgtgaagctgcgcacctacgtcaagcagctcaacgaggactgccggctgcgcctgcggaagttccgcaaggacggcgacggcaaggcccgggccatccccctcgtgggggagatggcgaccttcctgtcccaggacatcgtgcgcatgatcatcagcgaggagacgaagaagctgatcacctccgcctactacaacgagatgcagcggagcctcgcccagtacgccggcgaggagaaccgccggcagttccgcgcgatcgtcgccgagctgcacctcctggacccctccagcgggcacccgttcctgtccgccaccatggagaccgcccaccggtacacggaggacttctacaagtgctacctggagaagaagcgcgagtggctcgccaagaccttctaccggcccgagcaggacgagaacaccaagcgccggatcagcgtgttcttcgtgcccgacggcgaggcgcgcaagctgctgcccctcctgatccggcgccgcatgaaggagcagaacgacctgcaggactggatccggaacaagcaggcccacccgatcgacctcccctcccacctgttcgacagcaagatcatggagctgctcaaggtcaaggacgggaagaagaagtggaacgaggccttcaaggactggtggagcaccaagtaccccgacggcatgcagccgttctacggcctgcgccgggagctgaacatccacgggaagtccgtgagctacatcccctccgacggcaagaagttcgccgactgctacacgcacctcatggagaagaccgtccaggacaagaagcgcgagctgcggaccgccgggaagcccgtgcccccggacctggcggccgacatcaagcgcagcttccaccgggccgtgaacgagcgcgagttcatgctccggctggtccaggaggacgaccgcctgatgctcatggccatcaacaagatgatgaccgaccgggaggaggacatcctgcccggcctgaagaacatcgactccatcctcgacgaggagaaccagttcagcctggccgtgcacgcgaaggtgctggagaaggagggggagggcggcgacaactccctcagcctggtccccgccacgatcgagatcaagtccaagcgcaaggactggagcaagtacatccggtaccgctacgaccggcgcgtgcccgggctgatgtcccacttcccggagcacaaggccaccctcgacgaggtgaagaccctgctgggcgagtacgaccggtgccgcatcaagatcttcgactgggccttcgcgctcgagggggccatcatgagcgaccgggacctgaagccctacctgcacgagtccagctcccgcgagggcaagagcggcgagcactccaccctcgtcaagatgctggtggagaagaaggggtgcctgacgcccgacgagagccagtacctcatcctgatccgcaacaaggccgcccacaaccagttcccctgcgccgcggagatgccgctgatctaccgggacgtgtccgccaaggtcggcagcatcgaggggagctccgccaaggacctccccgagggcagctccctggtggacagcctgtggaagaagtacgagatgatcatccgcaagatcctccccatcctggaccccgagaaccggttcttcgggaagctgctcaacaacatgtcccagccgatcaacgacctgtga

SEQ ID NO: 11197 - RNA, 3408 nt, synthetic construct
  misc_feature 1..3408: note = Cas13b variant__Porohyromonas gulae__WP_039445055.1__Cas13b
  source 1..3408: mol_type = other RNA
atgaacaccgtgcccgccaccgagaacaagggccagagccgcacggtcgaggacgacccgcagtacttcgggctgtacctcaacctggcccgggagaacctgatcgaggtggagtcccacgtgcgcatcaagttcggcaagaagaagctcaacgaggagagcctgaagcagtccctgctctgcgaccacctcctgagcatcgaccggtggaccaaggtctacgggcactcccgccggtacctgcccttcctgcactgcttcgaccccgacagcggcatcgagaaggaccacgactccaagaccggggtggaccccgacagcgcgcagcgcctgatccgggagctctactccctgctggacttcctccgcaacgacttcagccacaaccggctggacggcaccacgttcgagcacctgaaggtgtccccggacatcagctccttcatcaccggcgcctacaccttcgcctgcgagcgcgcccagagccggttcgccgacttcttcaagcccgacgacttcctcctggcgaagaaccgcaaggagcagctgatctccgtcgccgacgggaaggagtgcctcaccgtgagcggcttcgccttcttcatctgcctgttcctggaccgggagcaggcctccgggatgctcagccgcatccggggcttcaagcgcacggacgagaactgggcgcgggccgtgcacgagaccttctgcgacctgtgcatccgccacccccacgaccggctggagtccagcaacaccaaggaggccctcctgctggacatgctcaacgagctgaaccgctgcccccggatcctgtacgacatgctcccggaggaggagcgcgcccagttcctgcccgccctggacgagaacagcatgaacaacctctccgagaacagcctgaacgaggagtcccgcctgctctgggacgggagctccgactgggcggaggccctgaccaagcggatccgccaccaggaccggttcccctacctgatgctccgcttcatcgaggagatggacctgctgaagggcatccggttccgcgtcgacctcggcgagatcgagctggacagctactccaagaaggtggggcggaacggcgagtacgaccgcacgatcaccgaccacgccctggccttcgggaagctcagcgacttccagaacgaggaggaggtgtcccggatgatcagcggcgaggcctcctaccccgtccgcttcagcctgttcgcgccgcggtacgccatctacgacaacaagatcggctactgccacacctccgaccccgtgtaccccaagagcaagaccggggagaagcgcgccctgtccaacccccagagcatgggcttcatctccgtgcacgacctgcggaagctcctgctgatggagctcctgtgcgaggggagcttctcccgcatgcagagcgacttcctgcggaaggccaaccgcatcctcgacgagacggccgagggcaagctgcagttcagcgcgctgttcccggagatgcggcaccgcttcatcccgccccagaaccccaagtccaaggaccggcgcgagaaggccgagaccaccctcgagaagtacaagcaggagatcaaggggcgcaaggacaagctgaacagccagctgctctccgccttcgacatgaaccagcggcagctgcccagccgcctgctcgacgagtggatgaacatccggcccgcctcccacagcgtcaagctgcgcacctacgtgaagcagctgaacgaggactgccggctccgcctgcggaagttccgcaaggacggcgacggcaaggcccgggcgatccccctggtgggggagatggccacgttcctctcccaggacatcgtccgcatgatcatcagcgaggagaccaagaagctgatcacctccgcctactacaacgagatgcagcggagcctggcccagtacgcgggcgaggagaaccgccggcagttccgcgccatcgtggccgagctccacctcctggacccctccagcgggcacccgttcctgtccgccaccatggagacggcccaccggtacaccgaggacttctacaagtgctacctggagaagaagcgcgagtggctggcgaagaccttctaccggcccgagcaggacgagaacaccaagcgccggatcagcgtgttcttcgtccccgacggcgaggcccgcaagctcctgcccctgctcatccggcgccgcatgaaggagcagaacgacctgcaggactggatccggaacaagcaggcccacccgatcgacctgccctcccacctcttcgacagcaagatcatggagctgctgaaggtgaaggacgggaagaagaagtggaacgaggccttcaaggactggtggtccacgaagtaccccgacggcatgcagccgttctacggcctccgccgggagctgaacatccacggcaagagcgtgagctacatcccctccgacgggaagaagttcgccgactgctacacccacctgatggagaagaccgtccgcgacaagaagcgggagctccgcaccgcggggaagcccgtgcccccggacctggccgcctacatcaagcggagcttccaccgcgccgtcaacgagcgggagttcatgctgcgcctcgtgcaggaggacgaccggctgatgctgatggccatcaacaagatgatgacggaccgcgaggaggacatcctccccggcctgaagaacatcgactccatcctggacgaggagaaccagttcagcctcgcggtgcacgccaaggtcctggagaaggagggggagggcggcgacaactccctgagcctcgtgcccgccaccatcgagatcaagtccaagcggaaggactggagcaagtacatccgctaccggtacgaccgccgggtgcccgggctgatgtcccacttcccggagcacaaggccaccctggacgaggtcaagaccctcctgggcgagtacgaccgctgccggatcaagatcttcgactgggcgttcgccctggagggggccatcatgagcgaccgcgacctcaagccctacctgcacgagtccagctcccgcgagggcaagagcggcgagcactccacgctggtgaagatgctcgtggagaagaaggggtgcctgacccccgacgagagccagtacctgatcctcatccggaacaaggccgcccacaaccagttcccctgcgcggccgagatgccgctgatctaccgcgacgtctccgccaaggtgggcagcatcgaggggtccagcgccaaggacctgcccgagggcagctccctcgtggacagcctgtggaagaagtacgagatgatcatccggaagatcctgcccatcctcgaccacgagaaccgcttcttcgggaagctgctgaacaacatgtcccagcccatcaacgacctctga

SEQ ID NO: 11198 - RNA, 3528 nt, synthetic construct
  misc_feature 1..3528: note = Cas13b variant__Porphyromonas gingivalis__WP_052912312.1__Cas13b
  source 1..3528: mol_type = other RNA
atgaccgagcagaacgagaagccctacaacggcacctactacacgctggaggacaagcacttctgggccgccttcttcaacctcgcgcgccacaacgcctacatcaccctggcccacatcgaccggcagctggcctacagcaaggccgacatcaccaacgacgaggacatcctcttcttcaaggggcagtggaagaacctggacaacgacctggagcgcaaggcgcggctccgctccctgatcctgaagcacttcagcttcctcgagggcgccgcctacgggaagaagctgttcgagtcccagagctccggcaacaagagctccaagaagaaggagctgaccaagaaggagaaggaggagctccaggccaacgcgctgagcctggacaacctcaagtccatcctgttcgacttcctgcagaagctcaaggacttccggaactactacagccactaccgccacccggagtccagcgagctgcccctgttcgacgggaacatgctccagcggctgtacaacgtgttcgacgtctccgtgcagcgcgtgaagcgggaccacgagcacaacgacaaggtcgacccccaccgccacttcaaccacctggtgcggaagggcaagaaggacaagtacggcaacaacgacaaccccttcttcaagcaccacttcgtggaccgcgaggagaaggtcacggaggccgggctcctgttcttcgtgagcctgttcctcgagaagcgggacgccatctggatgcagaagaagatccgcggcttcaagggcgggaccgaggcctaccagcagatgaccaacgaggtgttctgccggtcccgcatcagcctgccgaagctgaagctcgagtccctgcggaccgacgactggatgctgctcgacatgctgaacgagctggtccgctgccccaagctcctgtacgaccggctgcgcgaggaggaccgggcccgcttccgcgtgcccgtggacatcctcagcgacgaggacgacacggacgggaccgaggaggaccccttcaagaacaccctggtccggcaccaggaccgcttcccgtacttcgcgctgcggtacttcgacctcaagaaggtgttcacctccctgcgcttccacatcgacctgggcacgtaccacttcgccatctacaagaagaacatcggcgagcagcccgaggaccggcacctcacccgcaacctgtacgggttcggccggatccaggacttcgccgaggagcaccgccccgaggagtggaagcggctggtgcgcgacctcgactacttcgagaccggggacaagccctacatcacccagacgaccccgcactaccacatcgagaagggcaagatcggcctgcggttcgtccccgaggggcagctgctgtggcccagccccgaggtgggcgccacccgcaccgggcggagcaagtacgcccaggacaagcgcttcacggcggaggccttcctctccgtgcacgagctgatgccgatgatgttctactacttcctgctccgggagaagtacagcgaggaggcctccgccgagaaggtccagggccgcatcaagcgggtgatcgaggacgtgtacgccgtctacgacgcgttcgcccgcgacgagatcaacacccgggacgagctggacgcctgcctggccgacaaggggatccgccgcggccacctcccccggcagatgatcgccatcctgagccaggagcacaaggacatggaggagaaggtgcgcaagaagctgcaggagatgatcgcggacaccgaccaccggctcgacatgctggaccgccagaccgaccggaagatccgcatcggccggaagaacgccgggctgcccaagtccggcgtgatcgccgactggctcgtccgcgacatgatgcggttccagcccgtggccaaggacacgagcgggaagccgctgaacaactccaaggcgaacagcaccgagtaccgcatgctgcagcgggccctcgccctgttcggcggggagaaggagcgcctgaccccctacttccggcagatgaacctcaccggcggcaacaacccccaccccttcctgcacgagacgcgctgggagtcccacaccaacatcctgagcttctaccggtcctacctcaaggcccgcaaggccttcctgcagagcatcgggcggtccgaccgcgaggagaaccaccggttcctgctcctgaaggagccgaagaccgaccgccagaccctggtcgcgggctggaagtccgagttccacctcccccgggggatcttcacggaggccgtgcgcgactgcctgatcgagatgggctacgacgaggtggggagctacaaggaggtcggcttcatggccaaggccgtgcccctgtacttcgagcgcgcctgcaaggaccgggtgcagcccttctacgactacccgttcaacgtcggcaacagcctcaagcccaagaaggggcgcttcctgtccaaggagaagcgggcggaggagtgggagagcggcaaggagcgcttccgggacctggaggcctggtcccacagcgccgcccgccggatcgaggacgccttcgtggggatcgagtacgcgagctgggagaacaagaagaagatcgagcagctcctgcaggacctgtccctctgggagaccttcgagagcaagctgaaggtgaaggccgacaagatcaacatcgccaagctgaagaaggagatcctcgaggccaaggagcacccctaccacgacttcaagtcctggcagaagttcgagcgcgagctgcggctggtcaagaaccaggacatcatcacctggatgatgtgccgcgacctcatggaggagaacaaggtggagggcctggacaccggcacgctgtacctcaaggacatccggaccgacgtgcaggagcaggggagcctgaacgtcctgaaccacgtgaagccgatgcgcctccccgtggtcgtgtaccgggcggactcccgcggccacgtgcacaaggaggaggcgcccctggccaccgtctacatcgaggagcgggacaccaagctgctcaagcaggggaacttcaagagcttcgtgaaggaccgccggctgaacggcctgttctccttcgtggacaccggggccctcgccatggagcagtaccccatcagcaagctgcgcgtcgagtacgagctggccaagtaccagacggcccgggtgtgcgccttcgagcagaccctcgagctggaggagtccctgctcacccgctacccgcacctccccgacgagagcttccgcgagatgctggagtcctggagcgaccccctgctggacaagtggcccgacctgcagcgggaggtgcgcctcctgatcgccgtccggaacgccttctcccacaaccagtacccgatgtacgacgagaccatcttcagctccatccgcaagtacgaccccagctccctggacgcgatcgaggagcggatgggcctcaacatcgcccaccgcctgagcgaggaggtgaagctggccaaggagatggtggagcggatcatccaggcctga

SEQ ID NO: 11199 - RNA, 3360 nt, synthetic construct
  misc_feature 1..3360: note = Cas13b variant__Porphyromonas gingivalis__WP_053444417.1__Cas13b
  source 1..3360: mol_type = other RNA
atgaccgagcagaacgagaagccctacaacggcacctactacacgctggaggacaagcacttctgggccgccttcctcaacctggcgcgccacaacgcctacatcaccctggcccacatcgaccggcagctcgcctacagcaaggccgacatcaccaacgacgaggacatcctgttcttcaaggggcagtggaagaacctggacaacgacctcgagcgcaaggcgcggctgcgctccctgatcctcaagcacttcagcttcctggagggcgccgcctacgggaagaagctgttcgagtcccagagctccggcaacaagagctccaagaagaaggagctcagcaagaaggagaaggaggagctgcaggccaacgcgctgtccctcgacaacctcaagagcatcctgttcgacttcctccagaagctgaaggacttccggaactactactcccactaccgccacccggagagctccgagctgcccctcttcgacgggaacatgctgcagcggctgtacaacgtgttcgacgtcagcgtgcagcgcgtgaagcgggaccacgagcacaacgacaaggtcgacccccaccgccacttcaaccacctcgtgcggaagggcaagaaggacaagtacggcaacaacgacaaccccttcttcaagcaccacttcgtggaccgcgaggggaccgtcacggaggccggcctgctgttcttcgtgtccctcttcctggagaagcgggacgccatctggatgcagaagaagatccgcgggttcaagggcgggaccgaggcctaccagcagatgaccaacgaggtgttctgccggagccgcatctccctgccgaagctcaagctggagagcctgcggaccgacgactggatgctcctggacatgctgaacgagctcgtccgctgccccaagtccctgtacgaccggctgcgcgaggaggaccgggcccgcttccgcgtgcccgtggacatcctcagcgacgaggacgacacggacggcaccgaggaggaccccttcaagaacaccctggtccggcaccaggaccgcttcccgtacttcgcgctgcggtacttcgacctcaagaaggtgttcaccagcctgcgcttccacatcgacctgggcacgtaccacttcgccatctacaagaagaacatcggggagcagcccgaggaccggcacctcacccgcaacctgtacggcttcgggcggatccaggacttcgccgaggagcaccgccccgaggagtggaagcggctggtgcgcgacctcgactacttcgagaccggcgacaagccctacatcacccagacgaccccgcactaccacatcgagaagggcaagatcgggctgcggttcgtccccgagggccagcacctgtggccctcccccgaggtgggggccacccgcaccggccggagcaagtacgcccaggacaagcgcctgacggcggaggccttcctctccgtgcacgagctgatgccgatgatgttctactacttcctgctccgggagaagtacagcgaggaggtctccgccgagaaggtgcaggggcgcatcaagcgggtgatcgaggacgtctacgccgtgtacgacgccttcgcgcgcgacgagatcaacacccgggacgagctggacgcctgcctggccgacaagggcatccgccgcggccacctcccccggcagatgatcgccatcctgagccaggagcacaaggacatggaggagaaggtgcgcaagaagctgcaggagatgatcgccgacaccgaccaccggctcgacatgctggaccgccagaccgaccggaagatccgcatcgggcggaagaacgcgggcctgcccaagtccggggtcgtggccgactggctcgtccgcgacatgatgcggttccagcccgtggccaaggacacgagcggcaagccgctgaacaactccaaggccaacagcaccgagtaccgcatgctgcagcgggcgctcgccctgttcgggggcgagaaggagcgcctgaccccctacttccggcagatgaacctcaccggcgggaacaacccccaccccttcctgcacgagacgcgctgggagtcccacaccaacatcctgagcttctaccggtcctacctcgaggcccgcaaggccttcctgcagagcatcggccggtccgaccgcgtggagaaccaccggttcctgctcctgaaggagccgaagaccgaccgccagaccctggtcgccgggtggaagggcgagttccacctcccccgggggatcttcacggaggcggtgcgcgactgcctgatcgagatgggctacgacgaggtgggcagctacaaggaggtcgggttcatggccaaggccgtgcccctgtacttcgagcgcgcctccaaggaccgggtgcagcccttctacgactacccgttcaacgtcggcaacagcctcaagcccaagaaggggcgcttcctgtccaaggagaagcgggccgaggagtgggagagcggcaaggagcgcttccggctggcgaagctcaagaaggagatcctggaggccaaggagcacccctaccacgacttcaagagctggcagaagttcgagcgcgagctgcggctcgtgaagaaccaggacatcatcacctggatgatgtgccgcgacctgatggaggagaacaaggtggagggcctggacaccgggaccctctacctgaaggacatccggacggacgtccaggagcagggctccctgaacgtgctcaaccgcgtgaagccgatgcggctgcccgtcgtggtgtaccgcgccgacagccgggggcacgtccacaaggagcaggcgcccctggccaccgtgtacatcgaggagcgcgacaccaagctcctgaagcagggcaacttcaagtccttcgtgaaggaccggcgcctgaacgggctgttcagcttcgtcgacaccggcgccctggccatggagcagtaccccatctccaagctgcgggtggagtacgagctcgccaagtaccagaccgcccgcgtgtgcgcgttcgagcagacgctggagctggaggagagcctcctgacccggtacccgcacctccccgacaagaacttccgcaagatgctggagtcctggagcgaccccctgctggacaagtggcccgacctccacggcaacgtccgcctgctgatcgccgtgcggaacgccttctcccacaaccagtacccgatgtacgacgagaccctcttcagctccatccgcaagtacgaccccagctcccccgacgccatcgaggagcggatggggctgaacatcgcccaccgcctgagcgaggaggtgaagcaggcgaaggagatggtcgagcggatcatccaggcctga

SEQ ID NO: 11200 - RNA, 3360 nt, synthetic construct
  misc_feature 1..3360: note = Cas13b variant__Porphyromonas gingivalis__WP_012458414.1__Cas13b
  source 1..3360: mol_type = other RNA
atgaccgagcagaacgagcgcccctacaacggcacctactacacgctggaggacaagcacttctgggccgccttcttcaacctcgcgcggcacaacgcctacatcaccctggcccacatcgaccgccagctggcctacagcaaggccgacatcaccaacgacgaggacatcctcttcttcaaggggcagtggaagaacctggacaacgacctggagcggaaggcgcgcctccggtccctgatcctgaagcacttcagcttcctcgagggcgccgcctacgggaagaagctgttcgagtcccagagctccggcaacaagagctccaagaagaaggagctgaccaagaaggagaaggaggagctccaggccaacgcgctgagcctggacaacctcaagtccatcctgttcgacttcctgcagaagctcaaggacttccgcaactactacagccactaccggcacccggagtccagcgagctgcccctgttcgacgggaacatgctccagcgcctgtacaacgtgttcgacgtctccgtgcagcgggtgaagcgcgaccacgagcacaacgacaaggtcgacccccaccggcacttcaaccacctggtgcgcaagggcaagaaggaccggtacggcaacaacgacaaccccttcttcaagcaccacttcgtggaccgcgaggagaaggtcacggaggccgggctcctgttcttcgtgagcctgttcctcgagaagcgggacgccatctggatgcagaagaagatccgcggcttcaagggcgggaccgagacctaccagcagatgaccaacgaggtgttctgccggtcccgcatcagcctgccgaagctgaagctcgagtccctgcggacggacgactggatgctgctcgacatgctgaacgagctggtccgctgccccaagagcctctacgaccggctgcgcgaggaggaccgcgcccggttccgcgtgcccgtggacatcctgtccgacgaggacgacaccgacgggaccgaggaggaccccttcaagaacaccctcgtccggcaccaggaccgcttcccgtacttcgccctgcggtacttcgacctgaagaaggtgttcacgagcctccgcttccacatcgacctgggcacctaccacttcgcgatctacaagaagaacatcggcgagcagcccgaggaccggcacctgacccgcaacctctacgggttcggccggatccaggacttcgccgaggagcaccgccccgaggagtggaagcggctggtgcgcgacctggactacttcgagaccggggacaagccctacatcacgcagaccaccccgcactaccacatcgagaagggcaagatcggcctccggttcgtccccgaggggcagcacctgtggcccagccccgaggtgggcgccacccgcacggggcggtccaagtacgcccaggacaagcgcctgaccgccgaggcgttcctgagcgtgcacgagctcatgccgatgatgttctactacttcctgctgcgggagaagtactccgacgaggccagcgccgagcgcgtccagggccggatcaagcgcgtgatcgaggacgtgtacgccgtctacgacgccttcgcgcgcggggagatcaacacccgggacgagctcgacgcctgcctggccgacaagggcatccgccggggccacctcccccgccagatgatcgggatcctgtcccaggagcacaaggacatggaggagaaggtgcggaagaagctgcaggagatgatcgtggacaccgaccaccgcctggacatgctcgaccggcagacggaccgcaagatccggatcggccgcaagaacgccgggctgcccaagagcggcgtcatcgccgactggctggtgcgggacatgatgcgcttccagcccgtcgcgaaggacacctccgggaagccgctcaacaacagcaaggccaactccaccgagtaccggatgctgcagcgcgccctggccctcttcggcggcgagaaggagcggctgaccccctacttccgccagatgaacctgaccgggggcaacaacccccaccccttcctccacgagacgcggtgggagagccacaccaacatcctgtccttctaccgcagctacctgaaggcgcggaaggccttcctccagtccatcgggcgcagcgaccgggtggagaaccaccgcttcctgctgctcaaggagccgaagaccgaccgccagacgctggtggccggctggaagggggagttccacctcccccggggcatcttcaccgaggccgtccgcgactgcctgatcgagatgggcctggacgaggtggggtcctacaaggaggtgggcttcatggccaaggcggtccccctgtacttcgagcgggcctgcaaggaccgcgtgcagcccttctacgactacccgttcaacgtggggaacagcctcaagcccaagaagggccggttcctgtccaaggagaagcgcgccgaggagtgggagagcggcaaggagcggttccgcctggccaagctcaagaaggagatcctggaggccaaggagcacccctacctggacttcaagtcctggcagaagttcgagcgggagctccgcctggtcaagaaccaggacatcatcacctggatgatctgccgggacctgatggaggagaacaaggtggaggggctcgacaccggcacgctgtacctgaaggacatccgcaccgacgtgcaggagcaggggaacctcaacgtcctgaaccgggtgaagccgatgcgcctgcccgtggtcgtgtaccgggcggacagccgcggccacgtgcacaaggagcaggcgcccctcgccaccgtctacatcgaggagcgggacaccaagctgctgaagcaggggaacttcaagagcttcgtgaaggaccgccggctcaacggcctgttctccttcgtggacaccggcgccctggccatggagcagtaccccatcagcaagctccgcgtcgagtacgagctggccaagtaccagacggcccgcgtgtgcgccttcgagcagaccctggagctcgaggagtccctgctgacccggtacccgcacctccccgacaagaacttccgcaagatgctggagagctggtccgaccccctgctcgacaagtggcccgacctgcacgggaacgtgcggctgctcatcgccgtccgcaacgcgttcagccacaaccagtacccgatgtacgacgaggccgtgttctccagcatccggaagtacgacccctccagccccgacgccatcgaggagcgcatgggcctgaacatcgcccaccggctgtccgaggaggtgaagcaggccaaggagatggcggagcgcatcatccaggcctga

SEQ ID NO: 11201 - RNA, 3360 nt, synthetic construct
  misc_feature 1..3360: note = Cas13b variant__Porphyromonas gingivalis__WP_039417390.1__Cas13b
  source 1..3360: mol_type = other RNA
atgaccgagcagaacgagcgcccctacaacggcacctactacacgctggaggacaagcacttctgggccgccttcttcaacctcgcgcggcacaacgcctacatcaccctggcccacatcgaccgccagctggcctacagcaaggccgacatcaccaacgacgaggacatcctcttcttcaaggggcagtggaagaacctggacaacgacctggagcggaaggcgcgcctccggtccctgatcctgaagcacttcagcttcctcgagggcgccgcctacgggaagaagctgttcgagtcccagagctccggcaacaagagctccaagaagaaggagctgaccaagaaggagaaggaggagctccaggccaacgcgctgagcctggacaacctcaagtccatcctgttcgacttcctgcagaagctcaaggacttccgcaactactacagccactaccggcacccggagtccagcgagctgcccctgttcgacgggaacatgctccagcgcctgtacaacgtgttcgacgtctccgtgcagcgggtgaagcgcgaccacgagcacaacgacaaggtcgacccccaccggcacttcaaccacctggtgcgcaagggcaagaaggaccggtacggcaacaacgacaaccccttcttcaagcaccacttcgtggaccgcgaggggacggtcaccgaggccggcctcctgttcttcgtgagcctgttcctcgagaagcgggacgccatctggatgcagaagaagatccgcgggttcaagggcgggaccgaggcctaccagcagatgaccaacgaggtgttctgccggtcccgcatcagcctgccgaagctgaagctcgagtccctgcggacggacgactggatgctgctcgacatgctgaacgagctggtccgctgccccaagagcctctacgaccggctgcgcgaggaggaccgcgcccggttccgcgtgcccatcgacatcctgtccgacgaggacgacaccgacggcaccgaggaggaccccttcaagaacaccctcgtgcggcaccaggaccgcttcccgtacttcgcgctgcggtacttcgacctgaagaaggtcttcacgagcctccgcttccacatcgacctgggcacctaccacttcgccatctacaagaagaacatcggggagcagcccgaggaccggcacctgacccgcaacctctacggcttcgggcggatccaggacttcgccgaggagcaccgccccgaggagtggaagcggctggtgcgcgacctggactacttcgagaccggcgacaagccctacatcacgcagaccaccccgcactaccacatcgagaagggcaagatcgggctccggttcgtgcccgagggccagcacctgtggcccagccccgaggtcggggccacccgcacgggccggtccaagtacgcccaggacaagcgcctgaccgcggaggccttcctgagcgtgcacgagctcatgccgatgatgttctactacttcctgctgcgggagaagtactccgaggaggtgagcgccgagaaggtccaggggcgcatcaagcgggtgatcgaggacgtgtacgccgtctacgacgccttcgcgcgcggcgagatcgacaccctcgaccgcctggacgcctgcctggccgacaagggcatccggcgcgggcacctcccccggcagatgatcgccatcctgtcccaggagcacaaggacatggaggagaaggtgcgcaagaagctgcaggagatgatcgccgacaccgaccaccggctcgacatgctggaccgccagacggaccggaagatccgcatcggccggaagaacgcggggctgcccaagagcggcgtgatcgccgactggctcgtccgcgacatgatgcggttccagcccgtggccaaggacacctccgggaagccgctgaacaacagcaaggccaactccaccgagtaccgcatgctgcagcgggcgctcgccctgttcggcggcgagaaggagcgcctgaccccctacttccggcagatgaacctcaccgggggcaacaacccccaccccttcctgcacgagacgcgctgggagagccacaccaacatcctgtccttctaccggagctacctcaaggcccgcaaggccttcctgcagtccatcgggcggagcgaccgcgaggagaaccaccggttcctgctcctgaaggagccgaagaccgaccgccagacgctggtcgccggctggaagtccgagttccacctcccccgcgggatcttcaccgaggcggtgcgggactgcctgatcgagatgggctacgacgaggtgggcagctacaaggaggtcgggttcatggccaaggccgtgcccctgtacttcgagcgcgcctgcaaggaccgggtgcagcccttctacgactacccgttcaacgtcggcaactccctcaagcccaagaaggggcgcttcctgagcaaggagaagcgggccgaggagtgggagtccggcaaggagcgcttccggctggcgaagctcaagaaggagatcctggaggccaaggagcacccctacctggacttcaagagctggcagaagttcgagcgcgagctccggctggtgaagaaccaggacatcatcacctggatgatgtgccgcgacctgatggaggagaacaaggtggagggcctcgacaccgggacgctgtacctgaaggacatccggaccgacgtccacgagcagggcagcctcaacgtgctgaaccgcgtgaagccgatgcggctgcccgtcgtggtgtaccgcgccgactcccgggggcacgtccacaaggagcaggcgcccctcgccaccgtgtacatcgaggagcgcgacaccaagctgctgaagcagggcaacttcaagagcttcgtgaaggaccggcgcctcaacgggctgttctccttcgtcgacaccggcgccctggccatggagcagtaccccatcagcaagctccgggtggagtacgagctggccaagtaccagacggcccgcgtgtgcgcgttcgagcagaccctggagctcgaggagtccctgctgacccgctacccgcacctccccgacaagaacttccggaagatgctggagagctggtccgaccccctgctcgacaagtggcccgacctgcaccgcaaggtccggctgctcatcgccgtgcgcaacgccttcagccacaaccagtacccgatgtacgacgaggccgtgttctccagcatccggaagtacgacccctccagccccgacgccatcgaggagcgcatgggcctgaacatcgcgcaccggctgtccgaggaggtcaagcaggccaaggagatggccgagcgcatcatccaggtgtga

SEQ ID NO: 11202 - RNA, 3528 nt, synthetic construct
  misc_feature 1..3528: note = Cas13b variant__Porphyromonas gingivalis__EOA10535.1__Cas13b
  source 1..3528: mol_type = other RNA
atgaccgagcagaacgagaagccctacaacggcacctactacacgctggaggacaagcacttctgggccgccttcttcaacctcgcgcgccacaacgcctacatcaccctgacccacatcgaccggcagctggcctacagcaaggccgacatcaccaacgacgaggacatcctcttcttcaaggggcagtggaagaacctggacaacgacctggagcgcaaggcccggctccgctccctgatcctgaagcacttcagcttcctcgagggcgcggcctacgggaagaagctgttcgagtcccagagctccggcaacaagagctccaagaagaaggagctgacgaagaaggagaaggaggagctccaggccaacgccctgagcctggacaacctcaagtccatcctgttcgacttcctgcagaagctcaaggacttccggaactactacagccactaccgccacccggagtccagcgagctgcccctgttcgacgggaacatgctccagcggctgtacaacgtgttcgacgtctccgtgcagcgcgtgaagcgggaccacgagcacaacgacaaggtcgacccccaccgccacttcaaccacctggtgcggaagggcaagaaggaccgctgcggcaacaacgacaaccccttcttcaagcaccacttcgtggaccgggaggagaaggtcaccgaggcggggctcctgttcttcgtgagcctgttcctcgagaagcgcgacgccatctggatgcagaagaagatccggggcttcaagggcgggaccgagacctaccagcagatgacgaacgaggtgttctgccgctcccggatcagcctgccgaagctgaagctcgagtccctgcgcaccgacgactggatgctgctcgacatgctgaacgagctggtccggtgccccaagagcctctacgaccgcctgcgggaggaggaccgcgcccgcttccgggtgcccgtggacatcctgtccgacgaggacgacaccgacgggaccgaggaggaccccttcaagaacacgctcgtccgccaccaggaccggttcccgtacttcgccctgcgctacttcgacctgaagaaggtgttcaccagcctccggttccacatcgacctgggcacctaccacttcgccatctacaagaagaacatcggcgagcagcccgaggaccgccacctgacccggaacctctacgggttcggccgcatccaggacttcgcggaggagcaccggcccgaggagtggaagcgcctggtgcgggacctggactacttcgagacgggggacaagccctacatcacccagaccaccccgcactaccacatcgagaagggcaagatcggcctccgcttcgtccccgaggggcagctgctgtggcccagccccgaggtgggcgccacgcggaccgggcgctccaagtacgcccaggacaagcggttcaccgccgaggccttcctgagcgtgcacgagctcatgccgatgatgttctactacttcctgctgcgcgagaagtactccgaggaggcgagcgccgagcgggtccagggccgcatcaagcgggtgatcgaggacgtgtacgccgtctacgacgccttcgcccgcggggagatcgacaccctcgaccgcctggacgcgtgcctggccgacaagggcatccggcgcggccacctcccccggcagatgatcgccatcctgtcccaggagcacaaggacatggaggagaaggtgcgcaagaagctgcaggagatgatcgccgacacggaccaccggctcgacatgctggaccgccagaccgaccggaagatccgcatcgggcggaagaacgccggcctgcccaagagcggggtgatcgcggactggctcgtccgcgacatgatgcggttccagcccgtggccaaggacacctccggcaagccgctgaacaacagcaaggccaactccaccgagtaccgcatgctgcagcgggccctcgcgctgttcgggggcgagaaggagcgcctgacgccctacttccggcagatgaacctcaccggcgggaacaacccccaccccttcctgcacgagacccgctgggagagccacaccaacatcctgtccttctaccggagctacctcaaggcccgcaaggccttcctgcagtccatcggccggagcgaccgcgtcgagaaccaccggttcctgctcctgaaggagccgaagacggaccgccagaccctggtggccgggtggaagggcgagttccacctcccccgcgggatcttcaccgaggccgtgcgggactgcctgatcgagatgggcctggacgaggtcggctcctacaaggaggtggggttcatggcgaaggccgtgcccctctacttcgagcgcgcctgcaaggaccgggtccagcccttctacgactacccgttcaacgtgggcaacagcctgaagcccaagaaggggcgcttcctgtccaaggagaagcgggccgaggagtgggagagcggcaaggagcgcttccgggacctcgaggcctggtcccacagcgcggcccgccggatcgaggacgccttcgccggcatcgagaacgccagccgcgagaacaagaagaagatcgagcagctgctgcaggacctctccctgtgggagaccttcgagagcaagctgaaggtgaaggcggacaagatcaacatcgccaagctcaagaaggagatcctggaggccaaggagcacccctacctggacttcaagtcctggcagaagttcgagcgggagctccgcctggtcaagaaccaggacatcatcacgtggatgatgtgccgggacctgatggaggagaacaaggtggaggggctcgacaccggcaccctgtacctgaaggacatccgcaccgacgtgcacgagcaggggagcctcaacgtcctgaaccgggtgaagccgatgcgcctgcccgtggtcgtgtaccgggccgactcccgcggccacgtgcacaaggagcaggcgcccctcgccaccgtctacatcgaggagcgggacacgaagctgctgaagcaggggaacttcaagagcttcgtgaaggaccgccgcctcaacggcctgttctccttcgtggacaccggcgccctggccatggagcagtaccccatcagcaagctccgggtcgagtacgagctggccaagtaccagaccgcgcgcgtgtgcgccttcgagcagaccctggagctcgaggagtccctgctgacgcggtacccgcacctccccgacaagaacttccgcaagatgctggagagctggtccgaccccctgctcgacaagtggcccgacctgcacgggaacgtgcggctgctcatcgccgtccgcaacgccttcagccacaaccagtacccgatgtacgacgagaccctgttctccagcatccggaagtacgacccctccagccccgacgccatcgaggagcgcatgggcctgaacatcgcgcaccggctctccgaggaggtgaagcaggccaaggagatggtggagcgcatcatccaggcctga

SEQ ID NO: 11203 - RNA, 3360 nt, synthetic construct
  misc_feature 1..3360: note = Cas13b variant__Porphyromonas gingivalis__WP_061156470.1__Cas13b
  source 1..3360: mol_type = other RNA
atgaccgagcagaacgagcgcccctacaacggcacctactacacgctggaggacaagcacttctgggccgccttcttcaacctcgcgcggcacaacgcctacatcaccctgacccacatcgaccgccagctggcctacagcaaggccgacatcaccaacgacgaggacatcctcttcttcaaggggcagtggaagaacctggacaacgacctggagcggaaggcccgcctccggtccctgatcctgaagcacttcagcttcctcgagggcgcggcctacgggaagaagctgttcgagaacaagtccagcggcaacaagtccagcaagaagaaggagctgacgaagaaggagaaggaggagctccaggccaacgccctgtccctggacaacctcaagagcatcctgttcgacttcctgcagaagctcaaggacttccgcaactactactcccactaccggcacccggagagctccgagctgcccctgttcgacgggaacatgctccagcgcctgtacaacgtgttcgacgtcagcgtgcagcgggtgaagcgcgaccacgagcacaacgacaaggtcgacccccaccggcacttcaaccacctggtgcgcaagggcaagaaggaccggtgcggcaacaacgacaaccccttcttcaagcaccacttcgtggaccgcgaggggaaggtcaccgaggcgggcctcctgttcttcgtgtccctgttcctcgagaagcgggacgccatctggatgcagaagaagatccgcgggttcaagggcgggaccgaggcctaccagcagatgaccaacgaggtgttctgccggagccgcatctccctgccgaagctgaagctcgagagcctgcggacggacgactggatgctgctcgacatgctgaacgagctggtccgctgccccaagtccctctacgaccggctgcgcgaggaggaccgcgcccggttccgcgtgcccgtggacatcctgagcgacgaggacgacaccgacggcaccgaggaggaccccttcaagaacaccctcgtccggcaccaggaccgcttcccgtacttcgccctgcggtacttcgacctgaagaaggtgttcacgtccctccgcttccacatcgacctgggcacctaccacttcgcgatctacaagaagaacatcggggagcagcccgaggaccggcacctgacccgcaacctctacggcttcgggcggatccaggacttcgccgaggagcaccgccccgaggagtggaagcggctggtgcgcgacctggactacttcgagaccggcgacaagccctacatcacgcagaccaccccgcactaccacatcgagaagggcaagatcgggctccggttcgtccccgagggccagcacctgtggcccagccccgaggtgggggccacccgcacgggccggagcaagtacgcccaggacaagcgcctgaccgccgaggcgttcctgtccgtgcacgagctcatgccgatgatgttctactacttcctgctgcgggagaagtacagcgaggaggtctccgccgagaaggtgcaggggcgcatcaagcgggtgatcgaggacgtctacgccgtgtacgacgccttcgcccgcggcgagatcgacaccctcgaccgcctggacgcgtgcctggccgacaagggcatccggcgcgggcacctcccccggcagatgatcgccatcctgagccaggagcacaaggacatggaggagaaggtgcgcaagaagctgcaggagatgatcgccgacaccgaccaccggctcgacatgctggaccgccagacggaccggaagatccgcatcggccggaagaacgccgggctgcccaagtccggcgtcatcgcggactggctcgtgcgcgacatgatgcggttccagcccgtcgccaaggacaccagcgggaagccgctgaacaactccaaggccaacagcaccgagtaccgcatgctgcagcgggccctcgcgctgttcggcggcgagaaggagcgcctgaccccctacttccggcagatgaacctcaccgggggcaacaacccccaccccttcctgcacgagacgcgctgggagtcccacaccaacatcctgagcttctaccggtcctacctcaaggcccgcaaggccttcctgcagagcatcgggcggtccgaccgcgaggagaaccaccggttcctgctcctgaaggagccgaagaccgaccgccagacgctggtggccggctggaagtccgagttccacctcccccgcgggatcttcaccgaggccgtgcgggactgcctgatcgagatgggctacgacgaggtcggcagctacaaggaggtggggttcatggcgaaggccgtgcccctgtacttcgagcgcgcctgcaaggaccgggtccagcccttctacgactacccgttcaacgtgggcaacagcctcaagcccaagaaggggcgcttcctgtccaaggagaagcgggccgaggagtgggagagcggcaaggagcgcttccggctggccaagctcaagaaggagatcctggaggcgaaggagcacccctacctggacttcaagtcctggcagaagttcgagcgcgagctccggctggtgaagaaccaggacatcatcacctggatgatgtgccgcgacctgatggaggagaacaaggtcgagggcctcgacaccgggacgctgtacctgaaggacatccggaccgaggtgcaggagcagggcagcctcaacgtgctgaaccgcgtcaagccgatgcggctgcccgtggtggtctaccgcgccgacagccgggggcacgtgcacaaggagcaggcgcccctcgccaccgtgtacatcgaggagcgcgacaccaagctgctgaagcagggcaacttcaagtccttcgtcaaggaccggcgcctcaacgggctgttcagcttcgtggacaccggcggcctggccatggagcagtaccccatctccaagctccgggtggagtacgagctggccaagtaccagacggcccgcgtctgcgccttcgagcagaccctggagctcgaggagagcctgctgacccgctgcccgcacctccccgacaagaacttccggaagatgctggagtcctggagcgaccccctgctcgacaagtggcccgacctgcagcgcgaggtgtggctgctcatcgccgtgcggaacgcgttctcccacaaccagtacccgatgtacgacgaggccgtcttcagctccatccgcaagtacgaccccagctcccccgacgccatcgaggagcggatggggctgaacatcgcccaccgcctgagcgaggaggtgaagcaggccaaggagatggcggagcggatcatccaggcctga

SEQ ID NO: 11204 - RNA, 3360 nt, synthetic construct
  misc_feature 1..3360: note = Cas13b variant__Porphyromonas gingivalis__WP_013816155.1__Cas13b
  source 1..3360: mol_type = other RNA
atgaccgagcagaacgagaagccctacaacggcacctactacacgctggaggacaagcacttctgggccgccttcttcaacctcgcgcgccacaacgcctacatcaccctggcccacatcgaccggcagctggcctacagcaaggccgacatcaccaacgacgaggacatcctcttcttcaaggggcagtggaagaacctggacaacgacctggagcgcaaggcgcggctccgctccctgatcctgaagcacttcagcttcctcgagggcgccgcctacgggaagaagctgttcgagtcccagagctccggcaacaagagctccaagaacaaggagctgaccaagaaggagaaggaggagctccaggccaacgcgctgagcctggacaacctcaagtccatcctgttcgacttcctgcagaagctcaaggacttccggaactactacagccactaccgccacccggagtccagcgagctgcccctgttcgacgggaacatgctccagcggctgtacaacgtgttcgacgtctccgtgcagcgcgtgaagcgggaccacgagcacaacgacaaggtcgacccccaccgccacttcaaccacctggtgcggaagggcaagaaggaccgctacggcaacaacgacaaccccttcttcaagcaccacttcgtggaccgggaggggacggtcaccgaggccggcctcctgttcttcgtgagcctgttcctcgagaagcgcgacgccatctggatgcagaagaagatccgggggttcaagggcgggaccgagacctaccagcagatgacgaacgaggtgttctgccgctcccggatcagcctgccgaagctgaagctcgagtccctgcgcaccgacgactggatgctgctcgacatgctgaacgagctggtccggtgccccaagagcctctacgaccgcctgcgggaggaggaccgcgcccgcttccgggtgcccgtggacatcctgtccgacgaggaggacaccgacggcgccgaggaggaccccttcaagaacaccctcgtccgccaccaggaccggttcccgtacttcgcgctgcgctacttcgacctgaagaaggtgttcacgagcctccggttccagatcgacctgggcacctaccacttcgccatctacaagaagaacatcggggagcagcccgaggaccgccacctgacccggaacctctacggcttcgggcgcatccaggacttcgccgaggagcaccggcccgaggagtggaagcgcctggtgcgggacctggactacttcgagaccggcgacaagccctacatcacgcagaccaccccgcactaccacatcgagaagggcaagatcgggctccgcttcgtccccgagggccagcacctgtggcccagccccgaggtgggggccacccggacgggccgctccaagtacgcccaggacaagcggttcaccgcggaggccttcctgagcgcccacgagctgatgccgatgatgttctactacttcctcctgcgcgagaagtactccgaggaggccagcgccgagcgggtgcaggggcgcatcaagcgggtcatcgaggacgtgtacgcggtgtacgacgccttcgcccgcgacgagatcaacacccgcgacgagctggacgcctgcctcgccgacaagggcatccggcgcggccacctcccccggcagatgatcgggatcctgtcccaggagcacaaggacatggaggagaagatccgcaagaagctgcaggagatgatggcggacaccgaccaccggctggacatgctggaccgccagacggaccggaagatccgcatcggccggaagaacgccgggctccccaagagcggcgtcatcgccgactggctggtgcgcgacatgatgcggttccagcccgtggccaaggacacctccgggaagccgctgaacaacagcaaggcgaactccaccgagtaccgcatgctccagcgggccctggccctgttcggcggcgagaaggagcgcctcaccccctacttccggcagatgaacctgaccgggggcaacaacccccaccccttcctgcacgagacgcgctgggagagccacaccaacatcctctccttctaccggagctacctgaaggcccgcaaggccttcctgcagtccatcgggcggagcgaccgcgtcgagaaccaccggttcctcctgctgaaggagccgaagaccgaccgccagacgctcgtggcgggctggaagggggagttccacctcccccgcggcatcttcaccgaggccgtccgggactgcctgatcgagatgggcctggacgaggtggggtcctacaaggaggtgggcttcatggccaaggccgtccccctgtacttcgagcgcgcctgcaaggactgggtgcagcccttctacaactacccgttcaacgtggggaacagcctgaagcccaagaagggccggttcctctccaaggagaagcgcgcggaggagtgggagagcggcaaggagcggttccgcctggccaagctgaagaaggagatcctcgaggccaaggagcacccctacctggacttcaagtcctggcagaagttcgagcgggagctgcgcctcgtcaagaaccaggacatcatcacctggatgatctgcggggacctgatggaggagaacaaggtggagggcctggacaccgggacgctctacctgaaggacatccggaccgacgtgcaggagcagggcagcctgaacgtcctcaaccgcgtgaagccgatgcggctgcccgtggtcgtgtaccgcgccgacagccgggggcacgtgcacaaggagcaggcgcccctggccaccgtctacatcgaggagcgcgacaccaagctcctgaagcagggcaacttcaagtccttcgtgaaggaccggcgcctgaacggcctcttcagcttcgtggacaccggggccctggccatggagcagtaccccatctccaagctgcgggtcgagtacgagctcgccaagtaccagacggcgcgcgtgtgcgccttcgagcagaccctggagctggaggagagcctcctgacccggtgcccgcacctccccgacaagaacttccgcaagatgctggagtcctggagcgaccccctgctggacaagtggcccgacctccaccgcaaggtgcggctgctgatcgccgtccgcaacgccttctcccacaaccagtacccgatgtacgacgaggccgtgttcagctccatccggaagtacgaccccagcttccccgacgcgatcgaggagcgcatgggcctcaacatcgcccaccggctgtccgaggaggtgaagcaggccaaggagaccgtcgagcgcatcatccaggcctga

SEQ ID NO: 11205 - RNA, 3528 nt, synthetic construct
  misc_feature 1..3528: note = Cas13b variant__Porphyromonas gingivalis__WP_005874195.1__Cas13b
  source 1..3528: mol_type = other RNA
atgaccgagcagaacgagaagccctacaacggcacctactacacgctggaggacaagcacttctgggccgccttcttcaacctcgcgcgccacaacgcctacatcaccctggcccacatcgaccggcagctggcctacagcaaggccgacatcaccaacgacgaggacatcctcttcttcaaggggcagtggaagaacctggacaacgacctggagcgcaaggcgcggctccgctccctgatcctgaagcacttcagcttcctcgagggcgccgcctacgggaagaagctgttcgagtcccagagctccggcaacaagagctccaagaagaaggagctgaccaagaaggagaaggaggagctccaggccaacgcgctgagcctggacaacctcaagtccatcctgttcgacttcctgcagaagctcaaggacttccggaactactacagccactaccgccacccggagtccagcgagctgcccctgttcgacgggaacatgctccagcggctgtacaacgtgttcgacgtctccgtgcagcgcgtgaagcgggaccacgagcacaacgacaaggtcgacccccaccgccacttcaaccacctggtgcggaagggcaagaaggacaagtacggcaacaacgacaaccccttcttcaagcaccacttcgtggaccgcgaggagaaggtcacggaggccgggctcctgttcttcgtgagcctgttcctcgagaagcgggacgccatctggatgcagaagaagatccgcggcttcaagggcgggaccgaggcctaccagcagatgaccaacgaggtgttctgccggtcccgcatcagcctgccgaagctgaagctcgagtccctgcggaccgacgactggatgctgctcgacatgctgaacgagctggtccgctgccccaagagcctctacgaccggctgcgcgaggaggaccgggcccgcttccgcgtgcccgtggacatcctgtccgacgaggacgacacggacgggaccgaggaggaccccttcaagaacaccctcgtccggcaccaggaccgcttcccgtacttcgcgctgcggtacttcgacctgaagaaggtgttcaccagcctccgcttccacatcgacctgggcacgtaccacttcgccatctacaagaagaacatcggcgagcagcccgaggaccggcacctgacccgcaacctctacgggttcggccggatccaggacttcgccgaggagcaccgccccgaggagtggaagcggctggtgcgcgacctggactacttcgagaccggggacaagccctacatcacccagacgaccccgcactaccacatcgagaagggcaagatcggcctccggttcgtccccgaggggcagctgctgtggcccagccccgaggtgggcgccacccgcaccgggcggtccaagtacgcccaggacaagcgcttcacggcggaggccttcctgagcgtgcacgagctcatgccgatgatgttctactacttcctgctgcgggagaagtactccgaggaggccagcgccgagaaggtccagggccgcatcaagcgggtgatcgaggacgtgtacgccgtctacgacgcgttcgcccgcgacgagatcaacacccgggacgagctcgacgcctgcctggccgacaaggggatccgccgcggccacctcccccggcagatgatcgccatcctgtcccaggagcacaaggacatggaggagaaggtgcgcaagaagctgcaggagatgatcgcggacaccgaccaccggctggacatgctcgaccgccagaccgaccggaagatccgcatcggccggaagaacgccgggctgcccaagagcggcgtgatcgccgactggctggtccgcgacatgatgcggttccagcccgtggccaaggacacgtccgggaagccgctcaacaacagcaaggcgaactccaccgagtaccgcatgctgcagcgggccctggccctcttcggcggggagaaggagcgcctgaccccctacttccggcagatgaacctgaccggcggcaacaacccccaccccttcctccacgagacgcgctgggagagccacaccaacatcctgtccttctaccggagctacctgaaggcccgcaaggccttcctccagtccatcgggcggagcgaccgcgaggagaaccaccggttcctgctgctcaaggagccgaagaccgaccgccagaccctggtcgcgggctggaagtccgagttccacctcccccgggggatcttcacggaggccgtgcgcgactgcctgatcgagatgggctacgacgaggtggggagctacaaggaggtcggcttcatggccaaggccgtgcccctgtacttcgagcgcgcctgcaaggaccgggtgcagcccttctacgactacccgttcaacgtcggcaactccctgaagcccaagaaggggcgcttcctcagcaaggagaagcgggcggaggagtgggagtccggcaaggagcgcttccgggacctggaggcctggagccacagcgccgcccgccggatcgaggacgccttcgtggggatcgagtacgcgtcctgggagaacaagaagaagatcgagcagctgctccaggacctgagcctgtgggagaccttcgagtccaagctcaaggtgaaggccgacaagatcaacatcgccaagctgaagaaggagatcctggaggccaaggagcacccctaccacgacttcaagagctggcagaagttcgagcgcgagctccggctggtcaagaaccaggacatcatcacctggatgatgtgccgcgacctgatggaggagaacaaggtggagggcctcgacaccggcacgctgtacctgaaggacatccggaccgacgtgcaggagcaggggtccctcaacgtcctgaaccacgtgaagccgatgcgcctgcccgtggtcgtgtaccgggcggacagccgcggccacgtgcacaaggaggaggcgcccctcgccaccgtctacatcgaggagcgggacaccaagctgctgaagcaggggaacttcaagtccttcgtgaaggaccgccggctcaacggcctgttcagcttcgtggacaccggggccctggccatggagcagtaccccatctccaagctccgcgtcgagtacgagctggccaagtaccagacggcccgggtgtgcgccttcgagcagaccctggagctcgaggagagcctgctgacccgctacccgcacctccccgacgagtccttccgcgagatgctggagagctggtccgaccccctgctcgacaagtggcccgacctgcagcgggaggtgcgcctgctcatcgccgtccggaacgccttcagccacaaccagtacccgatgtacgacgagaccatcttctccagcatccgcaagtacgacccctccagcctggacgcgatcgaggagcggatgggcctgaacatcgcccaccgcctcagcgaggaggtgaagctggccaaggagatggtggagcggatcatccaggcctga

SEQ ID NO: 11206 - RNA, 3360 nt, synthetic construct
  misc_feature 1..3360: note = Cas13b variant__Porphyromonas gulae__WP_039437199.1__Cas13b
  source 1..3360: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgacgaggacatcctgttcttcaaggggcagtggaagaacctggacaacgacctcgagcgcaagagccggctgcggtccctgatcctcaagcacttcagcttcctggagggcgccgcgtacgggaagaagttcttcgagtccaagagctccggcaacaagagctccaagaacaaggagctgacgaagaaggagaaggaggagctccaggccaacgccctgagcctggacaacctcaagtccatcctgttcgacttcctgcagaagctcaaggacttccgcaactactacagccactaccggcactccgggagctccgagctgccgctgttcgacggcaacatgctccagcgcctgtacaacgtgttcgacgtcagcgtgcagcgggtgaagcgcgaccacgagcacaacgacgaggtcgacccccactaccacttcaaccacctggtgcggaagggcaagaaggaccgctacgggcacaacgacaacccctccttcaagcaccacttcgtggacggcgaggggatggtcaccgaggccggcctcctgttcttcgtgagcctgttcctcgagaagcgggacgcgatctggatgcagaagaagatccgcgggttcaagggcggcaccgagccctacgagcagatgaccaacgaggtgttctgccggtcccgcatcagcctgccgaagctgaagctcgagagcctgcggacggacgactggatgctgctcgacatgctgaacgagctggtccgctgccccaagcccctctacgaccggctgcgcgagaaggaccgggcctgcttccgcgtgcccgtggacatcctgccggacgaggacgacaccgacgggggcggggaggaccccttcaagaacaccctcgtccgccaccaggaccggttcccctacttcgccctgcgctacttcgacctgaagaaggtgttcacctccctccggttccacatcgacctgggcacgtaccacttcgccatctacaagaagatgatcggcgagcagcccgaggaccgccacctgacccggaacctctacgggttcggccgcatccaggacttcgccgaggagcaccggccggaggagtggaagcgcctggtgcgggacctggactacttcgagaccggggacaagccctacatcagccagaccacgccccactaccacatcgagaagggcaagatcgggctccgcttcgtccccgagggccagcacctgtggccgtcccccgaggtgggcaccacccggaccgggcgcagcaagtacgcgcaggacaagcggctgacggccgaggccttcctgtccgtgcacgagctcatgcccatgatgttctactacttcctgctgcgcgagaagtacagcgaggaggtctccgccgagaaggtgcagggccggatcaagcgcgtgatcgaggacgtctacgccatctacgacgcgttcgcccgggacgagatcaacaccctcaaggagctggacgcctgcctggccgacaaggggatccgccggggccacctccccaagcagatgatcgggatcctgagccaggagcgcaaggacatggaggagaaggtgcgcaagaagctgcaggagatgatcgccgacaccgaccaccggctcgacatgctggaccgccagaccgaccggaagatccgcatcggccggaagaacgcgggcctgccgaagtccggggtgatcgccgactggctcgtccgcgacatgatgcggttccagcccgtggccaaggacacgagcggcaagcccctgaacaactccaaggccaacagcaccgagtaccgcatgctgcagcgggccctcgcgctgttcgggggcgagaaggagcgcctgaccccctacttccggcagatgaacctcaccgggggcaacaacccgcaccccttcctgcacgagacgcgctgggagtcccacaccaacatcctgagcttctaccggtcctacctccgcgcccggaaggccttcctggagcgcatcggccggagcgaccgcgtcgagaactgccccttcctgctcctgaaggagcccaagaccgaccggcagaccctggtggccgggtggaagggcgagttccacctcccgcgcgggatcttcacggaggcggtgcgggactgcctgatcgagatgggctacgacgaggtcggctcctaccgcgaggtggggttcatggccaaggccgtgcccctgtacttcgagcgcgcctgcgaggaccgggtccagcccttctacgacagcccgttcaacgtgggcaactccctcaagcccaagaaggggcgcttcctgagcaaggagaagcgggccgaggagtgggagagcggcaaggagcgcttccggctggcgaagctcaagaaggagatcctggaggcccaggagcacccctaccacgacttcaagtcctggcagaagttcgagcgcgagctgcggctcgtgaagaaccaggacatcatcacctggatgatgtgccgcgacctgatggaggagaacaaggtcgaggggctggacaccggcaccctctacctgaaggacatccggcccaacgtgcaggagcagggcagcctgaacgtgctcaaccgcgtcaagccgatgcggctgcccgtggtggtctaccgcgccgactcccgggggcacgtgcacaaggaggaggcgcccctggccacggtgtacatcgaggagcgcgacaccaagctcctgaagcagggcaacttcaagagcttcgtcaaggaccggcgcctgaacgggctgttctccttcgtggacaccggcgccctggccatggagcagtaccccatcagcaagctgcgggtggagtacgagctcgccaagtaccagaccgcccgcgtctgcgccttcgagcagaccctggagctggaggagtccctcctgacgcggtacccgcacctccccgacgagagcttccgcgagatgctcgagtcctggagcgaccccctgctgaccaagtggcccgagctccacgggaaggtgcgcctgctgatcgcggtgcggaacgccttctcccacaaccagtacccgatgtacgacgaggccgtcttcagctccatctggaagtacgaccccagctcccccgacgccatcgaggagcgcatgggcctcaacatcgcgcaccggctgagcgaggaggtgaagcaggccaaggagaccatcgagcgcatcatccaggcctga

SEQ ID NO: 11207 - RNA, 3360 nt, synthetic construct
  misc_feature 1..3360: note = Cas13b variant__Porphyromonas gulae__WP_039419792.1__Cas13b
  source 1..3360: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacctcgacaacgacctggagcggaagtcccgcctgcggagcctcatcctgaagcacttctccttcctggagggggcggcctacggcaagaagctgttcgagagcaagtccagcgggaacaagtccagcaagaacaaggagctgacgaagaaggagaaggaggagctgcaggccaacgccctctccctggacaacctcaagagcatcctcttcgacttcctgcagaagctgaaggacttccgcaactactactcccactaccggcacagcggctccagcgagctcccgctgttcgacgggaacatgctgcagcgcctctacaacgtcttcgacgtgtccgtgcagcgggtcaagcgcgaccacgagcacaacgacaaggtggacccccaccggcacttcaaccacctggtgcgcaagggcaagaaggaccggtacggccacaacgacaaccccagcttcaagcaccacttcgtcgacggggagggcatggtgaccgaggcggggctgctgttcttcgtgtccctgttcctggagaagcgcgacgccatctggatgcagaagaagatccggggcttcaagggcgggaccgagacctaccagcagatgacgaacgaggtcttctgccgcagccggatcagcctccccaagctgaagctggagtccctccgcaccgacgactggatgctgctggacatgctcaacgagctggtgcggtgcccgaagcccctgtacgaccgcctccgggagaaggaccgcgcccgcttccgggtgcccgtcgacatcctgcccgacgaggacgacaccgacggcgggggcgaggacccgttcaagaacaccctggtgcgccaccaggaccggttcccctacttcgccctccgctacttcgacctgaagaaggtgttcacgagcctgcggttccacatcgacctcgggacctaccacttcgccatctacaagaaggtcatcggcgagcagcccgaggaccgccacctgacccggaacctgtacggcttcgggcgcatccaggacttcgcggaggagcaccggcccgaggagtggaagcgcctcgtgcgggacctggactacttcgagaccggcgacaagccgtacatctcccagacgacgccccactaccacatcgagaaggggaagatcggcctgcgcttcgtgcccgaggggcagcacctgtggcccagcccggaggtcggcaccacccggaccggccgctccaagtacgcccaggacaagcggctcaccgccgaggccttcctgagcgtgcacgagctgatgcccatgatgttctactacttcctcctgcgcgagaagtactccgaggaggtgagcgccgagaaggtccaggggcggatcaagcgcgtgatcgaggacgtgtacgcgatctacgacgccttcgcccgggacgagatcaacacccgcgacgagctggacgcctgcctcgccgacaagggcatccgccgggggcacctccccaagcagatgatcggcatcctgtcccaggagcacaagaacatggaggagaaggtccgcaagaagctccaggagatgatcgcggacaccgaccaccggctggacatgctggaccgccagacggaccggaagatccgcatcgggcggaagaacgccggcctccccaagagcggcgtgatcgccgactggctggtccgcgacatgatgcggttccagccggtggccaaggacacctccgggaagcccctgaacaacagcaaggccaactccaccgagtaccgcatgctccagcgggcgctggccctgttcggcggggagaaggagcgcctcaccccctacttccggcagatgaacctgacgggcgggaacaacccccacccgttcctggacgagacccgctgggagagccacaccaacatcctctccttctaccggagctacctgcgcgcccggaaggccttcctggagcgcatcggccggtccgaccgcgtggagaaccggcccttcctcctgctgaaggagcccaagaccgaccgccagacgctcgtcgcgggctggaagtccgagttccacctcccccgcgggatcttcaccgaggccgtgcgggactgcctgatcgagatgggctacgacgaggtggggagctacaaggaggtcggcttcatggccaaggccgtgccgctgtacttcgagcgcgcctgcaaggaccgggtgcagcccttctacgacagccccttcaacgtcggcaacagcctgaagccgaagaaggggcgcttcctgtccaaggagaagcgggcggaggagtgggagagcggcaaggagcgcttccggctcgccaagctgaagaaggagatcctggaggcccaggagcacccctaccacgacttcaagtcctggcagaagttcgagcgcgagctccggctggtgaagaaccaggacatcatcacctggatgatgtgccgcgacctgatggaggagaacaaggtggaggggctcgacaccggcacgctgtacctgaaggacatccggcccaacgtccaggagcaggggagcctcaacgtgctgaaccgcgtgaagcccatgcggctgccggtcgtggtgtaccgcgccgactcccggggccacgtccacaaggaggaggcgcccctcgccaccgtgtacatcgaggagcgcgacaccaagctgctgaagcagggcaacttcaagagcttcgtgaaggaccggcgcctcaacgggctgttctccttcgtcgacaccggcgggctggccatggagcagtaccccatcagcaagctccgggtggagtacgagctggccaagtaccagaccgcccgcgtgtgcgtcttcgagctgacgctccgcctggaggagtccctgctcagccggtacccccacctcccggacgagtccttccgcgagatgctggagagctggtccgaccccctgctggccaagtggcccgagctgcacggcaaggtgcggctcctgatcgcggtgcgcaacgccttcagccacaaccagtaccccatgtacgacgaggccgtcttctccagcatccggaagtacgacccgtccagccccgacgccatcgaggagcgcatggggctgaacatcgcgcaccggctcagcgaggaggtgaagcaggccaaggagaccgtggagcgcatcatccaggcctga

SEQ ID NO: 11208 - RNA, 3528 nt, synthetic construct
  misc_feature 1..3528: note = Cas13b variant__Porphyromonas gulae__WP_039431778.1__Cas13b
  source 1..3528: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacttcgacaacgacctcgagcggaagtcccgcctgcggagcctgatcctcaagcacttctccttcctggagggggcggcctacggcaagaagctgttcgagagcaagtccagcgggaacaagtccagcaagaacaaggagctcacgaagaaggagaaggaggagctgcaggccaacgccctgtccctcgacaacctcaagagcatcctgttcgacttcctgcagaagctgaaggacttccgcaactactactcccactaccggcacagcgagtccagcgagctgcccctcttcgacggcaacatgctgcagcgcctgtacaacgtcttcgacgtgtccgtgcagcgggtcaagcgcgaccacgagcacaacgacaaggtggacccccaccggcacttcaaccacctcgtgcgcaaggggaagaaggaccggtacggccacaacgacaaccccagcttcaagcaccacttcgtcgacggcgaggggatggtgaccgaggcgggcctgctgttcttcgtgtccctcttcctggagaagcgcgacgccatctggatgcagaagaagatccgggggttcaagggcgggaccgagacctaccagcagatgacgaacgaggtcttctgccgcagccggatcagcctgcccaagctcaagctggagtccctgcgcaccgacgactggatgctcctggacatgctgaacgagctcgtgcggtgcccgaagcccctgtacgaccgcctgcgggaggacgaccgcgcctgcttccgcgtgcccgtcgacatcctccccgacgaggacgacaccgacggcggcggggaggacccgttcaagaacaccctggtgcggcaccaggaccgcttcccctacttcgccctgcggtacttcgacctcaagaaggtgttcacgagcctgcgcttccacatcgacctgggcacctaccacttcgccatctacaagaagatgatcggggagcagcccgaggaccggcacctcacccgcaacctgtacggcttcggccggatccaggacttcgcggaggagcaccgccccgaggagtggaagcggctggtccgcgacctcgactacttcgagaccggggacaagccgtacatctcccagacgagcccccactaccacatcgagaagggcaagatcgggctgcggttcatgcccgagggccagcacctgtggccctccccggaggtggggaccacccgcaccggccggagcaagtacgcccaggacaagcgcctgacggccgaggccttcctctccgtgcacgagctgatgcccatgatgttctactacttcctgctccgggagaagtacagcgaggaggtctccgccgagaaggtgcagggccgcatcaagcgggtgatcgaggacgtctacgcgatctacgacgccttcgcccgcgacgagatcaacaccctgaaggagctggacgcctgcctcgccgacaaggggatccggcgcggccacctccccaagcagatgatcgcgatcctgagccaggagcacaaggacatggaggagaagatccgcaagaagctgcaggagatgatcgccgacaccgaccaccggctggacatgctggaccgccagaccgaccggaagatccgcatcgggcggaagaacgccggcctccccaagtccggggtgatcgccgactggctggtgcgcgacatgatgcggttccagccggtcgccaaggacacgagcggcaagcccctgaacaactccaaggcgaacagcaccgagtaccgcatgctccagcgggccctggccctgttcggcggggagaagaagcgcctcaccccctacttccggcagatgaacctgaccggcgggaacaacccccacccgttcctgcacgagacgcgctgggagtcccacaccaacatcctcagcttctaccggtcctacctgcgcgcccggaaggcgttcctggagcgcatcggccggagcgaccgcatggagaaccggcccttcctcctgctgaaggagcccaagaccgaccgccagaccctcgtggccgggtggaagtccgagttccacctcccccggggcatcttcacggaggccgtccgcgactgcctgatcgagatgggctacgacgaggtggggagctaccgcgaggtgggcttcatggccaaggccgtcccgctgtacttcgagcgggcgtgcgaggaccgcgtgcagcccttctacgacagccccttcaacgtggggaactccctgaagccgaagaagggccggttcctgagcaaggaggagcgcgccgaggagtgggagcggggcaaggagcgcttccgggacctcgaggcctggtcccacagcgccgcccgccggatcgaggacgcgttcgccgggatcgagtacgcctcccccggcaacaagaagaagatcgagcagctgctgcgcgacctcagcctgtgggaggccttcgagtccaagctgaaggtccgggccgacaagatcaacctcgcgaagctgaagaaggagatcctggaggcccaggagcacccctaccacgacttcaagagctggcagaagttcgagcgcgagctccggctggtgaagaaccaggacatcatcacctggatgatgtgccgcgacctgatggaggagaacaaggtggaggggctcgacaccggcaccctgtacctgaaggacatccggcccaacgtccaggagcaggggtccctcaacgtgctgaaccgcgtgaagccgatgcggctgcccgtcgtggtgtaccgcgccgacagccggggccacgtccacaaggaggaggccccgctcgcgacggtgtacatcgaggagcgcgacaccaagctgctgaagcagggcaacttcaagtccttcgtgaaggaccgccggctcaacgggctgttcagcttcgtcgacaccggcgggctggccatggagcagtaccccatctccaagctccgcgtggagtacgagctggccaagtaccagaccgcccgggtgtgcgtcttcgagctgaccctccgcctggaggagagcctgctcacgcggtacccgcacctccccgacgagtccttccgcaagatgctggagagctggtccgaccccctgctggccaagtggcccgagctgcacggcaaggtgcggctcctgatcgcggtgcgcaacgccttcagccacaaccagtacccgatgtacgacgaggccgtcttcagctccatccggaagtacgaccccagctcccccgacgccatcgaggagcgcatggggctgaacatcgcccaccggctcagcgaggaggtgaagcaggcgaaggagaccgtggagcgcatcatccaggtctga

SEQ ID NO: 11209 - RNA, 3528 nt, synthetic construct
  misc_feature 1..3528: note = Cas13b variant__Porphyromonas gulae__WP_046201018.1__Cas13b
  source 1..3528: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacttcgacaacgacctcgagcggaagtcccgcctgcggagcctgatcctcaagcacttctccttcctggagggggcggcctacggcaagaagctgttcgagagcaagtccagcgggaacaagtccagcaagaacaaggagctcacgaagaaggagaaggaggagctgcaggccaacgccctgtccctcgacaacctcaagagcatcctgttcgacttcctgcagaagctgaaggacttccgcaactactactcccactaccggcacagcgagtccagcgagctgcccctcttcgacggcaacatgctgcagcgcctgtacaacgtcttcgacgtgtccgtgcagcgggtcaagcgcgaccacgagcacaacgacaaggtggacccccaccggcacttcaaccacctcgtgcgcaaggggaagaaggaccggtacggccacaacgacaaccccagcttcaagcaccacttcgtcgactccgagggcatggtgaccgaggcggggctgctgttcttcgtgagcctcttcctggagaagcgcgacgccatctggatgcagaagaagatccggggcttcaagggcgggaccgagacctaccagcagatgacgaacgaggtcttctgccgcagccggatctccctgcccaagctcaagctggagagcctgcgcaccgacgactggatgctcctggacatgctgaacgagctcgtgcggtgcccgaagcccctgtacgaccgcctgcgggagaaggaccgcgcccgcttccgggtgcccgtcgacatcctccccgacgaggacgacaccgacgggggcggcgaggacccgttcaagaacaccctggtgcgccaccaggaccggttcccctacttcgccctgcgctacttcgacctcaagaaggtgttcacgtccctgcggttccacatcgacctggggacctaccacttcgccatctacaagaagatgatcggcgagcagcccgaggaccgccacctcacccggaacctgtacgggttcggccgcatccaggacttcgcggaggagcaccggcccgaggagtggaagcgcctggtccgggacctcgactacttcgagaccggcgacaagccgtacatcagccagacgacgccccactaccacatcgagaaggggaagatcggcctgcgcttcatgcccgaggggcagcacctgtggccctccccggaggtgggcaccacccggacggggcgcagcaagtacgcccaggacaagcggctgaccgccgaggccttcctctccgtgcacgagctgatgcccatgatgttctactacttcctgctccgcgagaagtacagcgaggaggtctccgccgagaaggtgcagggccggatcaagcgcgtgatcgaggacgtctacgcgatctacgacgccttcgcccgggacgagatcaacaccctgaaggagctggacgcctgcctcgccgacaagggcatccgccgcgggcacctccccaagcagatgatcgcgatcctgagccaggagcacaaggacatggaggagaagatccggaagaagctgcaggagatgatcgccgacaccgaccaccgcctggacatgctggaccggcagacggaccgcaagatccggatcggccgcaagaacgccgggctccccaagtccggcgtgatcgccgactggctggtgcgggacatgatgcgcttccagccggtcgccaaggacaccagcgggaagcccctgaacaactccaaggcgaacagcaccgagtaccggatgctccagcgcgccctggccctgttcggcggcgagaagaagcggctcaccccctacttccgccagatgaacctgaccgggggcaacaacccccacccgttcctgcacgagacccggtgggagtcccacaccaacatcctcagcttctaccgctcctacctgcgggcccgcaaggcgttcctggagcggatcgggcgcagcgaccggatggagaaccgccccttcctcctgctgaaggagcccaagaccgaccggcagacgctcgtggccggctggaagtccgagttccacctcccccgcgggatcttcaccgaggccgtccgcgactgcctgatcgagatgggctacgacgaggtgggcagctaccgggaggtggggttcatggccaaggccgtcccgctgtacttcgagcgcgcgtgcgaggaccgggtgcagcccttctacgacagccccttcaacgtgggcaactccctgaagccgaagaaggggcgcttcctgagcaaggaggagcgggccgaggagtgggagcgcggcaaggagcggttccgcgacctcgaggcctggtcccacagcgccgcccggcgcatcgaggacgcgttcgccggcatcgagtacgcctcccccgggaacaagaagaagatcgagcagctgctgcgggacctcagcctgtgggaggccttcgagtccaagctgaaggtccgcgccgacaagatcaacctcgcgaagctgaagaaggagatcctggaggcccaggagcacccctaccacgacttcaagagctggcagaagttcgagcgggagctccgcctggtgaagaaccaggacatcatcacctggatgatgtgccgggacctgatggaggagaacaaggtggagggcctcgacaccgggacgctgtacctgaaggacatccgccccaacgtccaggagcagggctccctcaacgtgctgaaccgggtgaagccgatgcgcctgcccgtcgtggtgtaccgggccgacagccgcgggcacgtccacaaggaggaggccccgctcgcgaccgtgtacatcgaggagcgcgacaccaagctgctgaagcagggcaacttcaagtccttcgtgaaggaccggcgcctcaacggcctgttcagcttcgtcgacaccgggggcctggccatggagcagtaccccatctccaagctccgggtggagtacgagctggccaagtaccagaccgcccgcgtgtgcgtcttcgagctgacgctccggctggaggagagcctgctcacccgctacccgcacctccccgacgagtccttccggaagatgctggagagctggtccgaccccctgctggccaagtggcccgagctgcacgggaaggtgcgcctcctgatcgcggtgcggaacgccttcagccacaaccagtacccgatgtacgacgaggccgtcttcagctccatccgcaagtacgaccccagctcccccgacgccatcgaggagcggatgggcctgaacatcgcccaccgcctcagcgaggaggtgaagcaggcgaaggagaccgtggagcggatcatccaggtctga

SEQ ID NO: 11210 - RNA, 3525 nt, synthetic construct
  misc_feature 1..3525: note = Cas13b variant__Porphyromonas gulae__WP_039442171.1__Cas13b
  source 1..3525: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacctcgacaacgacctggagcggaagtcccgcctgcggagcctcatcctgaagcacttctccttcctggagggggcggcctacggcaagaagctgttcgagagcaagtccagcgggaacaagtccagcaagaacaaggagctgacgaagaaggagaaggaggagctgcaggccaacgccctctccctggacaacctcaagagcatcctcttcgacttcctgcagaagctgaaggacttccgcaactactactcccactaccggcacagcggctccagcgagctcccgctgttcgacgggaacatgctgcagcgcctctacaacgtcttcgacgtgtccgtgcagcgggtcaagcgcgaccacgagcacaacgacaaggtggacccccactaccacttcaaccacctggtgcggaagggcaagaaggaccgctacggccacaacgacaaccccagcttcaagcaccacttcgtcgactccgaggggatggtgaccgaggcgggcctcctgttcttcgtgagcctgttcctggagaagcgggacgccatctggatgcagaagaagatccgcgggttcaagggcgggaccggcccctacgagcagatgaccaacgaggtcttctgccggagccgcatctccctcccgaagctgaagctggagagcctccggacggacgactggatgctgctggacatgctcaacgagctggtgcgctgccccaagcccctgtacgaccggctccgcgagaaggaccgggcctgcttccgcgtgcccgtcgacatcctgccggacgaggacgacaccgacggcgggggcgaggaccccttcaagaacaccctggtgcgccaccaggaccggttcccctacttcgccctccgctacttcgacctgaagaaggtgttcacctccctgcggttccacatcgacctcgggacgtaccacttcgccatctacaagaagatgatcggcgagcagcccgaggaccgccacctgacccggaacctgtacggcttcgggcgcatccaggacttcgcggaggagcaccggccggaggagtggaagcgcctcgtccgggacctggactacctggagaccggcgacaagccctacatcagccagaccacgccccactaccacatcgagaaggggaagatcggcctgcgcttcgtgcccgaggggcagcacctctggccgtcccccgaggtgggcaccacccggaccggccgcagcaagtgcgcccaggacaagcggctgacggccgaggccttcctgtccgtccacgagctcatgcccatgatgttctactacttcctgctgcgcgagaagtacagcgaggaggtgtccgccgagaaggtgcaggggcggatcaagcgcgtcatcgaggacgtgtacgcgatctacgacgccttcgcccgggacgagatcaacaccctcaaggagctggacacgtgcctggccgacaagggcatccgccgggggcacctccccaagcagatgatcaccatcctgagccaggagcgcaaggacatgaaggagaagatccgcaagaagctgcaggagatgatcgccgacacggaccaccggctcgacatgctggaccgccagaccgaccggaagatccgcatcggccggaagaacgcggggctgccgaagtccggcgtgatcgccgactggctcgtccgcgacatgatgcggttccagcccgtggccaaggacgccagcggcaagcccctgaacaactccaaggccaacagcaccgagtaccgcatgctgcagcgggcgctcgccctgttcgggggcgagaaggagcgcctgaccccctacttccggcagatgaacctcaccgggggcaacaacccgcaccccttcctgcacgagacccgctgggagtcccacaccaacatcctgagcttctaccggtcctacctccgcgcccggaaggccttcctggagcgcatcgggcggagcgaccgcgtcgagaactgccccttcctgctcctgaaggagcccaagaccgaccggcagacgctggtggcgggctggaaggacgagttccacctcccgcgcggcatcttcaccgaggccgtgcgggactgcctgatcgagatggggtacgacgaggtcggctcctaccgcgaggtggggttcatggccaaggccgtgcccctgtacttcgagcgcgcctgcgaggaccgggtccagcccttctacgacagcccgttcaacgtgggcaacagcctcaagcccaagaagggccgcttcctgtccaaggaggaccgggcggaggagtgggagcgcgggatggagcggttccgcgacctggaggcctggagccactccgccgcccggcgcatcaaggacgccttcgcgggcatcgagtacgccagccccgggaacaagaagaagatcgagcagctcctgcgggacctgtccctctgggaggccttcgagagcaagctgaaggtgcgcgccgacaagatcaacctggccaagctcaagaaggagatcctggaggcgcaggagcacccctaccacgacttcaagtcctggcagaagttcgagcgggagctgcgcctcgtcaagaaccaggacatcatcacctggatgatgtgccgggacctgatggaggagaacaaggtggagggcctggacaccgggacgctctacctgaaggacatccgcccgaacgtgcaggagcagggcagcctgaacgtcctcaaccgggtgaagcccatgcgcctgcccgtggtcgtgtaccgggccgactcccgcggccacgtgcacaaggaggcgcccctggccaccgtctacatcgaggagcggaacaccaagctcctgaagcaggggaacttcaagagcttcgtgaaggaccgccgcctgaacggcctcttctccttcgtggacaccgggggcctggccatggagcagtacccgatcagcaagctgcgggtcgagtacgagctcgccaagtaccagaccgcccgcgtgtgcgtgttcgagctgacgctgcggctcgaggagtccctgctgagccgctacccccacctccccgacgagtccttccgggagatgctggagagctggtccgaccccctgctcgccaagtggccggagctgcacgggaaggtccgcctgctcatcgccgtgcggaacgcgttcagccacaaccagtaccccatgtacgacgaggccgtgttcagctccatccgcaagtacgaccccagctcccccgacgccatcgaggagcggatgggcctgaacatcgcccaccgcctgagcgaggaggtcaagcaggccaaggagaccgtggagcggatcatccaggcgtga

SEQ ID NO: 11211 - RNA, 3360 nt, synthetic construct
  misc_feature 1..3360: note = Cas13b variant__Porphyromonas gulae__WP_039426176.1__Cas13b
  source 1..3360: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacttcgacaacgacctcgagcggaagtcccgcctgcggagcctgatcctcaagcacttctccttcctggagggggcggcctacggcaagaagctgttcgagagcaagtccagcgggaacaagtccagcaagaacaaggagctcacgaagaaggagaaggaggagctgcaggccaacgccctgtccctcgacaacctcaagagcatcctgttcgacttcctccagaagctgaaggacttccgcaactactactcccactaccggcacagcggctccagcgagctgccgctgttcgacgggaacatgctgcagcgcctgtacaacgtcttcgacgtgtccgtgcagcgggtcaagcgcgaccacgagcacaacgacaaggtggacccccactaccacttcaaccacctcgtgcggaagggcaagaaggaccgctacggccacaacgacaaccccagcttcaagcaccacttcgtcgactccgaggggatggtgaccgaggcgggcctgctgttcttcgtgagcctcttcctggagaagcgggacgccatctggatgcagaagaagatccgcgggttcaagggcgggaccggcccctacgagcagatgaccaacgaggtcttctgccggagccgcatctccctgccgaagctcaagctggagagcctgcggacggacgactggatgctcctggacatgctgaacgagctcgtgcgctgccccaagcccctgtacgaccggctgcgcgagaaggaccgggcctgcttccgcgtgcccgtcgacatcctcccggacgaggacgacaccgacggcgggggcgaggaccccttcaagaacaccctggtgcgccaccaggaccggttcccctacttcgccctgcgctacttcgacctcaagaaggtgttcacctccctgcggttccacatcgacctggggacgtaccacttcgccatctacaagaagatgatcggcgagcagcccgaggaccgccacctcacccggaacctgtacggcttcgggcgcatccaggacttcgcggaggagcaccggccggaggagtggaagcgcctggtccgggacctcgactacttcgagaccggcgacaagccctacatcagccagaccacgccccactaccacatcgagaaggggaagatcggcctgcgcttcatgcccgaggggcagcacctgtggccgtcccccgaggtgggcaccacccggaccggccgcagcaagtacgcccaggacaagcggctgacggccgaggccttcctctccgtgcacgagctgatgcccatgatgttctactacttcctgctccgcgagaagtacagcgaggaggtctccgccgagaaggtgcaggggcggatcaagcgcgtgatcaaggacgtctacgcgatctacgacgccttcgcccgggacgagatcaacaccctgaaggagctggacgcctgcagcgccgacaagggcatccgccgggggcacctccccaagcagatgatcggcatcctgtcccaggagcacaagaacatggaggagaaggtgcgcaagaagctgcaggagatgatcgcggacaccgaccaccgcctcgacatgctggaccggcagaccgaccgcaagatccggatcgggcgcaagaacgccggcctgcccaagagcggcgtgatcgccgactggctcgtccgggacatgatgcgcttccagcccgtggccaaggacacgtccgggaagcccctgaacaacagcaaggccaactccaccgagtaccggatgctgcagcgcgcgctcgccctgttcggcggggagaaggagcggctgaccccctacttccgccagatgaacctcaccggcgggaacaacccgcaccccttcctggacgagacgcggtgggagagccacaccaacatcctgtccttctaccgcagctacctccgggcccgcaaggccttcctggagcggatcggccgctccgaccgggtcgagaaccgccccttcctgctcctgaaggagcccaagaacgaccggcagaccctggtggcgggctggaagtccgagttccacctcccgcgcgggatcttcaccgaggccgtgcgggactgcctgatcgagatgggctacgacgaggtcgggagctacaaggaggtgggcttcatggccaaggccgtgcccctgtacttcgagcgcgcctgcaaggaccgcgtccagcccttctacgacagcccgttcaacgtgggcaacagcctcaagcccaagaaggggcggttcctgtccaaggagaagcgcgcggaggagtgggagagcggcaaggagcggttccgcctggccaagctcaagaaggagatcctggaggccaaggagcacccctaccacgacttcaagtcctggcagaagttcgagcgggagctgcgcctcgtgaagaaccaggacatcatcacgtggatgatgtgccgggacctgatggaggagaacaaggtcgaggggctggacaccggcaccctctacctgaaggacatccgcaccgacgtgcacgagcaggggagcctgaacgtgctcaaccgggtcaagcccatgcgcctgccggtggtggtctaccgggccgactcccgcggccacgtgcacaaggagcaggccccgctggcgacggtgtacatcgaggagcgggacaccaagctcctgaagcagggcaacttcaagagcttcgtcaaggaccgccggctgaacgggctgttctccttcgtggacaccggcgggctggccatggagcagtaccccatcagcaagctgcgcgtggagtacgagctcgccaagtaccagaccgcccgggtctgcgccttcgagcagaccctggagctggaggagtccctcctgacgcgctacccccacctcccggacgagaacttccgggagatgctcgagagctggtccgaccccctgctgggcaagtggcccgacctccacgggaaggtgcgcctgctgatcgcggtgcgcaacgccttcagccacaaccagtaccccatgtacgacgaggccgtcttctccagcatccggaagtacgacccgtccagccccgacgccatcgaggagcgcatgggcctcaacatcgcgcaccggctgagcgaggaggtgaagcaggccaaggagaccgtggagcgcatcatccaggcctga

SEQ ID NO: 11212 - RNA, 3528 nt, synthetic construct
  misc_feature 1..3528: note = Cas13b variant__Porphyromonas gulae__WP_039418912.1__Cas13b
  source 1..3528: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacctcgacaacgacctggagcggaagtcccgcctgcggagcctcatcctgaagcacttctccttcctggagggggcggcctacggcaagaagctgttcgagagcaagtccagcgggaacaagtccagcaagaacaaggagctgacgaagaaggagaaggaggagctgcaggccaacgccctctccctggacaacctcaagagcatcctcttcgacttcctgcagaagctgaaggacttccgcaactactactcccactaccggcacagcggctccagcgagctcccgctgttcgacgggaacatgctgcagcgcctctacaacgtcttcgacgtgtccgtgcagcgggtcaagcgcgaccacgagcacaacgacaaggtggacccccaccggcacttcaaccacctggtgcgcaagggcaagaaggaccggtacggccacaacgacaaccccagcttcaagcaccacttcgtcgactccgaggggatggtgaccgaggcgggcctgctgttcttcgtgagcctgttcctggagaagcgcgacgccatctggatgcagaagaagatccgggggttcaagggcgggaccgagacctaccagcagatgacgaacgaggtcttctgccgcagccggatctccctccccaagctgaagctggagagcctccgcatggacgactggatgctgctggacatgctcaacgagctggtgcggtgcccgaagcccctgtacgaccgcctccgggaggacgaccgcgcctgcttccgcgtgcccgtcgacatcctgcccgacgaggacgacaccgacggcggcggggaggacccgttcaagaacaccctggtgcggcaccaggaccgcttcccctacttcgccctccggtacttcgacctgaagaaggtgttcacctccctgcgcttccacatcgacctcggcacgtaccacttcgccatctacaagaagatgatcggggagcagcccgaggaccggcacctgacccgcaacctgtacggcttcggccggatccaggacttcgcggaggagcaccgccccgaggagtggaagcggctcgtccgcgacctggactacttcgagaccggggacaagccgtacatcagccagaccagcccccactaccacatcgagaagggcaagatcgggctgcggttcatgcccgagggccagcacctgtggcccagcccggaggtggggacgacccgcaccggccggtccaagtacgcccaggacaagcgcctcaccgccgaggccttcctgagcgtgcacgagctgatgcccatgatgttctactacttcctcctgcgggagaagtactccgaggaggtcagcgccgagaaggtgcagggccgcatcaagcgggtgatcgaggacgtctacgcgatctacgacgccttcgcccgcgacgagatcaacacgctgaaggagctcgacgcctgcctggccgacaaggggatccggcgcggccacctccccaagcagatgatcgcgatcctctcccaggagcacaagaacatggaggagaaggtgcgcaagaagctgcaggagatgatcgccgacaccgaccaccggctggacatgctcgaccgccagaccgaccggaagatccgcatcgggcggaagaacgccggcctgcccaagagcggggtgatcgccgactggctggtccgcgacatgatgcggttccagccggtggccaaggacgcgtccggcaagcccctcaacaacagcaaggccaactccaccgagtaccgcatgctgcagcgggccctggccctcttcggcggggagaaggagcgcctgacgccctacttccggcagatgaacctgaccggcgggaacaacccccacccgttcctccacgacacccgctgggagagccacaccaacatcctgtccttctaccggagctacctgcgcgcgcggaaggccttcctcgagcgcatcggccggtccgaccgcatggagaaccggcccttcctgctgctcaaggagcccaagacggaccgccagaccctggtcgccgggtggaagtccgagttccacctcccccggggcatcttcaccgaggccgtgcgcgactgcctgatcgagatgggctacgacgaggtggggagctaccgcgaggtcggcttcatggccaaggcggtgccgctgtacttcgagcgggcctgcgaggaccgcgtgcagcccttctacgactcccccttcaacgtcgggaacagcctgaagccgaagaagggccggttcctctccaaggaggagcgcgccgaggagtgggagcggggcaaggagcgcttccgggacctggaggcctggagccactccgccgcgcgccggatcgaggacgccttcgccgggatcgagtacgccagccccggcaacaagaagaagatcgagcagctgctccgcgacctgtccctgtgggaggccttcgagagcaagctcaaggtgcgggcggacaagatcaacctggccaagctgaagaaggagatcctcgaggcccaggagcacccctaccacgacttcaagtcctggcagaagttcgagcgcgagctgcggctggtgaagaaccaggacatcatcacctggatgatgtgccgcgacctcatggaggagaacaaggtcgaggggctggacacgggcaccctgtacctcaaggacatccggaccaacgtgcaggagcaggggagcctgaacgtgctgaaccacgtcaagcccatgcgcctcccggtggtggtctaccgggccgactcccgcggccacgtgcacaaggaggaggcgcccctggccaccgtgtacatcgaggagcgggacacgaagctgctcaagcagggcaacttcaagagcttcgtcaaggaccgccgcctgaacgggctgttctccttcgtggacaccggcgggctcgccatggagcagtaccccatcagcaagctgcgggtggagtacgagctggccaagtaccagaccgcccgcgtctgcgcgttcgagcagaccctcgagctggaggagtccctgctcacccggtacccccacctcccggacaagaacttccgcaagatgctggagagctggtccgaccccctgctggccaagtggcccgagctgcacggcaaggtgcggctcctgatcgccgtgcgcaacgccttcagccacaaccagtaccccatgtacgacgaggccgtcttcagctccatccggaagtacgacccgagctcccccgacgcgatcgaggagcgcatggggctgaacatcgcccaccggctcagcgaggaggtgaagcaggccaaggagacggtggagcgcatcatccaggcctga

SEQ ID NO: 11213 - RNA, 3528 nt, synthetic construct
  misc_feature 1..3528: note = Cas13b variant__Porphyromonas gulae__WP_039434803.1__Cas13b
  source 1..3528: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacttcgacaacgacctcgagcggaagtcccgcctgcggagcctgatcctcaagcacttctccttcctggagggggcggcctacggcaagaagctgttcgagagcaagtccagcgggaacaagtccagcaagaacaaggagctcacgaagaaggagaaggaggagctgcaggccaacgccctgtccctcgacaacctcaagagcatcctgttcgacttcctgcagaagctgaaggacttccgcaactactactcccactaccggcacagcggctccagcgagctgcccctcttcgacgggaacatgctgcagcgcctgtacaacgtcttcgacgtgtccgtgcagcgggtcaagatcgaccacgagcacaacgacgaggtggacccccactaccacttcaaccacctcgtgcgcaagggcaagaaggaccggtacggccacaacgacaaccccagcttcaagcaccacttcgtcgacggggagggcatggtgaccgaggcggggctgctgttcttcgtgtccctcttcctggagaagcgcgacgccatctggatgcagaagaagatccggggcttcaagggcgggaccgagacctaccagcagatgacgaacgaggtcttctgccgcagccggatcagcctgcccaagctcaagctggagtccctgcgcatggacgactggatgctcctggacatgctgaacgagctcgtgcggtgcccgaagcccctgtacgaccgcctgcgggaggacgaccgcgcctgcttccgggtgcccgtcgacatcctccccgacgaggacgacaccgacggcgggggcgaggacccgttcaagaacaccctggtgcgccaccaggaccgcttcccctacttcgccctgcggtacttcgacctcaagaaggtgttcaccagcctgcgcttccacatcgacctggggacgtaccacttcgccatctacaagaagatgatcggcgagcagcccgaggaccggcacctcacccgcaacctgtacggcttcgggcggatccaggacttcgcggaggagcaccgccccgaggagtggaagcggctggtccgcgacctcgactacttcgagaccggcgacaagccgtacatctcccagaccagcccccactaccacatcgagaaggggaagatcggcctgcggttcatgcccgaggggcagcacctgtggccctccccggaggtgggcacgacccgcaccggccggagcaagtacgcccaggacaagcgcctgaccgccgaggccttcctctccgtgcacgagctgatgcccatgatgttctactacttcctgctccgggagaagtacagcgaggaggtctccgccgagcgcgtgcaggggcggatcaagcgcgtgatcgaggacgtctacgcggtgtacgacgccttcgcccgggacgagatcaacacgcgcgacgagctggacgcctgcctggccgacaagggcatccggcgcgggcacctcccccgccagatgatcgcgatcctgagccaggagcacaaggacatggaggagaagatccggaagaagctgcaggagatgatggccgacaccgaccaccgcctcgacatgctggaccggcagaccgaccgcaagatccggatcggccgcaagaacgccgggctgcccaagtccggcgtgatcgccgactggctcgtccgggacatgatgcgcttccagccggtggccaaggacgcgagcggcaagcccctgaacaactccaaggccaacagcaccgagtaccggatgctgcagcgcgccctcgccctgttcgggggcgagaaggagcggctgacgccctacttccgccagatgaacctcaccgggggcaacaacccccacccgttcctgcacgagacccggtgggagtcccacaccaacatcctgagcttctaccgctcctacctccgggcgcgcaaggccttcctggagcggatcgggcgcagcgaccgggtcgagaaccgccccttcctgctcctgaaggagcccaagacggaccggcagaccctggtggccggctggaagggcgagttccacctcccccgcgggatcttcaccgaggccgtgcgcgactgcctgatcgagatgggccacgacgaggtcgcctcctacaaggaggtggggttcatggcgaaggccgtgccgctgtacttcgagcgggcctgcgaggaccgcgtccagcccttctacgacagccccttcaacgtgggcaacagcctcaagccgaagaagggccggttcctgtccaaggaggagcgcgccgaggagtgggagcgggggaaggagcgcttccgggacctggaggcctggagctactccgcggcccgccggatcgaggacgccttcgccggcatcgagtacgccagccccgggaacaagaagaagatcgagcagctcctgcgcgacctgtccctctgggaggcgttcgagagcaagctgaaggtgcgggccgaccgcatcaacctggccaagctcaagaaggagatcctggaggcccaggagcacccctaccacgacttcaagtcctggcagaagttcgagcgggagctgcgcctcgtcaagaaccaggacatcatcacctggatgatgtgccgggacctgatggaggagaacaaggtggagggcctggacacggggaccctctacctgaaggacatccgccccaacgtgcaggagcagggcagcctgaacgtcctcaaccgggtgaagccgatgcgcctgcccgtggtcgtgtaccgggcggactcccgcggccacgtgcacaaggaggaggccccgctggccaccgtctacatcgaggagcgcgacaccaagctcctgaagcaggggaacttcaagagcttcgtgaaggaccggcgcctgaacggcctcttctccttcgtggacaccgggggcctggccatggagcagtaccccatcagcaagctgcgggtcgagtacgagctcgccaagtaccagacggcgcgcgtgtgcgtgttcgagctgaccctgcggctcgaggagtccctgctgacccgctacccgcacctccccgacgagagcttccgggagatgctggagtcctggagcgaccccctgctcgccaagtggcccgagctgcacgggaaggtccgcctgctcatcgccgtgcggaacgccttctcccacaaccagtacccgatgtacgacgaggccgtgttcagcagcatccgcaagtacgacccctccagccccgacgcgatcgaggagcggatgggcctgaacatcgcccaccgcctgtccgaggaggtcaagcaggccaaggagaccgtggagcggatcatccaggcctga

SEQ ID NO: 11214 - RNA, 3528 nt, synthetic construct
  misc_feature 1..3528: note = Cas13b variant__Porphyromonas sp.__WP_039428968.1__Cas13b
  source 1..3528: mol_type = other RNA
atgaccgagcagagcgagcgcccctacaacggcacctactacacgctggaggacaagcacttctgggccgccttcctcaacctggcgcggcacaacgcctacatcaccctgacccacatcgaccgccagctcgcctactccaaggccgacatcaccaacgaccaggacgtgctgagcttcaaggccctgtggaagaacttcgacaacgacctcgagcggaagtcccgcctgcggagcctgatcctcaagcacttctccttcctggagggggcggcctacggcaagaagctgttcgagagcaagtccagcgggaacaagtccagcaagaacaaggagctcacgaagaaggagaaggaggagctgcaggccaacgccctgtccctcgacaacctcaagagcatcctgttcgacttcctgcagaagctgaaggacttccgcaactactactcccactaccggcacagcgagtccagcgagctgcccctcttcgacggcaacatgctgcagcgcctgtacaacgtcttcgacgtgtccgtgcagcgggtcaagcgcgaccacgagcacaacgacaaggtggacccccaccggcacttcaaccacctcgtgcgcaaggggaagaaggaccggtacggccacaacgacaaccccagcttcaagcaccacttcgtcgactccgagggcatggtgaccgaggcggggctgctgttcttcgtgagcctcttcctggagaagcgcgacgccatctggatgcagaagaagatccggggcttcaagggcgggaccgagacctaccagcagatgacgaacgaggtcttctgccgcagccggatctccctgcccaagctcaagctggagagcctgcgcaccgacgactggatgctcctggacatgctgaacgagctcgtgcggtgcccgaagcccctgtacgaccgcctgcgggaggacgaccgcgcctgcttccgcgtgcccgtcgacatcctccccgacgaggacgacaccgacgggggcggcgaggacccgttcaagaacaccctggtgcggcaccaggaccgcttcccctacttcgccctgcggtacttcgacctcaagaaggtgttcacgtccctgcgcttccacatcgacctggggacctaccacttcgccatctacaagaagatgatcggcgagcagcccgaggaccggcacctcacccgcaacctgtacgggttcggccggatccaggacttcgcggaggagcaccgccccgaggagtggaagcggctggtccgcgacctcgactacttcgagaccggcgacaagccgtacatcagccagacgaccccgcactaccacatcgagaaggggaagatcggcctgcggttcgtgcccgaggggcagcacctgtggccctccccggaggtgggcaccacccgcacggggcggagcaagtacgcccaggacaagcgcctgaccgccgaggccttcctctccgtccacgagctgatgcccatgatgttctactacttcctgctccgggagaagtacagcgaggaggtgtccgccgagaaggtgcagggccgcatcaagcgggtcatcgaggacgtgtacgcgatctacgacgccttcgcccgcgacgagatcaacaccctgaaggagctggacgcctgcctcgccgacaagggcatccggcgcgggcacctccccaagcagatgatcggcatcctgagccaggagcgcaaggacatggaggagaaggtgcggaagaagctgcaggagatgatcgcggacaccgaccaccgcctggacatgctggaccggcagacggaccgcaagatccggatcgggcgcaagaacgccggcctccccaagtccggggtcatcgccgactggctggtgcgggacatgatgcgcttccagccggtcgccaaggacaccagcggcaagcccctgaacaactccaaggccaacagcaccgagtaccggatgctccagcgcgcgctggccctgttcggcggggagaaggagcggctcaccccctacttccgccagatgaacctgacgggcgggaacaacccccacccgttcctgcacgagacccggtgggagtcccacaccaacatcctcagcttctaccgctcctacctgcgggcccgcaaggccttcctggagcggatcggccgcagcgaccgggtggagaactgccccttcctcctgctgaaggagcccaagaccgaccgccagacgctcgtggcggggtggaagggcgagttccacctcccccggggcatcttcaccgaggccgtccgcgactgcctgatcgagatggggtacgacgaggtgggctcctaccgcgaggtggggttcatggccaaggccgtcccgctgtacttcgagcgggcctgcgaggaccgcgtgcagcccttctacgacagccccttcaacgtgggcaacagcctgaagccgaagaagggccggttcctgtccaaggaggaccgcgcggaggagtgggagcgggggaaggagcgcttccgggacctcgaggcctggagccactccgccgcccgccggatcaaggacgccttcgcgggcatcgagtacgccagccccgggaacaagaagaagatcgagcagctgctgcgcgacctctccctgtgggaggccttcgagagcaagctgaaggtccgggccgacaagatcaacctcgccaagctgaagaaggagatcctggaggcgcaggagcacccctaccacgacttcaagtcctggcagaagttcgagcgcgagctccggctggtgaagaaccaggacatcatcacctggatgatgtgccgcgacctgatggaggagaacaaggtggagggcctcgacaccgggacgctgtacctgaaggacatccggcccaacgtccaggagcagggcagcctcaacgtgctgaaccgcgtgaagccgatgcggctgcccgtcgtggtgtaccgcgccgactcccggggccacgtccacaaggaggaggcgcccctcgccaccgtgtacatcgaggagcgcgacaccaagctgctgaagcaggggaacttcaagagcttcgtgaaggaccgccggctcaacggcctgttctccttcgtcgacaccgggggcctggccatggagcagtaccccatcagcaagctccgcgtggagtacgagctggccaagtaccagaccgcccgggtgtgcgtcttcgagctgacgctccgcctggaggagtccctgctcagccggtacccgcacctccccgacgagtccttccgcgagatgctggagagctggtccgaccccctgctggccaagtggcccgagctgcacgggaaggtgcggctcctgatcgccgtgcgcaacgcgttcagccacaaccagtacccgatgtacgacgaggccgtcttcagctccatccggaagtacgaccccagctcccccgacgccatcgaggagcgcatgggcctgaacatcgcccaccggctcagcgaggaggtgaagcaggccaaggagaccgtggagcgcatcatccaggcgtga

SEQ ID NO: 11215 - RNA, 3375 nt, synthetic construct
  misc_feature 1..3375: note = Cas13b variant__Prevotella aurantiaca__WP_025000926.1__Cas13b
  source 1..3375: mol_type = other RNA
atggaggacgacaagaagaccaccggcagcatctcctacgagctgaaggacaagcacttctgggccgccttcctcaacctggcgcgccacaacgtgtacatcacgatcaaccacatcaacaagctgctcgagatccgggagatcgacaacgacgagaaggtcctggacatcaagaccctgtggcagaaggggaacaaggacctcaaccagaaggcccgcctgcgggagctgatgaccaagcacttccccttcctcgagaccgccatctacacgaagaacaaggaggacaagaaggaggtgaagcaggagaagcaggccgaggcccagagcctggagtccctgaaggactgcctcttcctgttcctggacaagctccaggaggcgcgcaactactacagccactacaagtactccgagttcagcaaggagccggagttcgaggagggcctgctggagaagatgtacaacatcttcgggaacaacatccagctcgtgatcaacgactaccagcacaacaaggacatcaaccccgacgaggacttcaagcacctggaccggaagggccagttcaagtactccttcgccgacaacgaggggaacatcaccgagagcggcctgctgttcttcgtctccctgttcctggagaagaaggacgccatctggatgcagcagaagctcaacggcttcaaggacaacctggagaacaagaagaagatgacccacgaggtgttctgccgcagccggatcctgatgcccaagctccgcctggagtccacccagacgcaggactggatcctgctcgacatgctgaacgagctgatccggtgccccaagagcctctacgagcgcctgcagggggacgaccgggagaagttcaaggtgccgttcgaccccgccgacgaggactacaacgcggagcaggagcccttcaagaacaccctgatccgccaccaggaccggttcccctacttcgtcctccgctacttcgactacaacgagatcttcaagaacctgcggttccagatcgacctgggcacctaccacttctccatctacaagaagctcatcgggggccagaaggaggaccgccacctgacccacaagctgtacgggttcgagcggatccaggagttcgccaagcagaaccgcccggacgagtggaaggccatcgtgaaggacctcgacacgtacgagaccagcaacaagcggtacatctccgagaccacgccccactaccacctggagaaccagaagatcggcatccgcttccggaacggcaacaaggagatctggcccagcctgaagaccaacgacgagaacaacgagaagtccaagtacaagctcgacaagcagtaccaggccgaggccttcctgagcgtgcacgagctgctccccatgatgttctactacctgctgctgaagaaggagaagccgaacaacgacgagatcaacgcgtccatcgtcgaggggttcatcaagcgcgagatccgcaacatcttcaagctctacgacgccttcgccaacggcgagatcaacaacatcgacgacctggagaagtactgcgccgacaaggggatccccaagcggcacctccccaagcagatggtggccatcctctacgacgagcacaaggacatggtgaaggaggcgaagcgcaagcagaaggagatggtcaaggacaccaagaagctgctggccaccctcgagaagcagacccagaaggagaaggaggacgacggccggaacgtgaagctgctcaagagcggcgagatcgcccgctggctggtgaacgacatgatgcggttccagcccgtccagaaggacaacgaggggaagccgctgaacaacagcaaggccaactccacggagtaccagatgctgcagcgcagcctcgccctgtacaacaacgaggagaagcccacccggtacttccgccaggtgaacctgatcgagtccaacaacccccaccccttcctcaagtggaccaagtgggaggagtgcaacaacatcctgaccttctactacagctacctgacgaagaagatcgagttcctcaacaagctgaagccggaggactggaagaagaaccagtacttcctgaagctcaaggagcccaagaccaaccgggagaccctggtgcagggctggaagaacgggttcaacctgccccgcggcatcttcaccgagcccatccgggagtggttcaagcgccaccagaacaactccaaggagtacgagaaggtcgaggcgctcgaccgggtggggctggtgacgaaggtcatcccgctgttcttcaaggaggagtacttcaaggacaaggaggagaacttcaaggaggacacccagaaggagatcaacgactgcgtgcagcccttctacaacttcccctacaacgtgggcaacatccacaagcccaaggagaaggacttcctccaccgcgaggagcggatcgagctgtgggacaagaagaaggacaagttcaagggctacaaggagaagatcaagagcaagaagctgaccgagaaggacaaggaggagttccgctcctacctcgagttccagagctggaacaagttcgagcgggagctgcgcctggtccggaaccaggacatcgtgacctggctcctgtgcaaggagctgatcgacaagctcaagatcgacgagctgaacatcgaggagctgaagaagctccgcctgaacaacatcgacacggacaccgccaagaaggagaagaacaacatcctgaaccgcgtcatgccgatggagctccccgtgaccgtgtacgagatcgacgactcccacaagatcgtcaaggacaagcccctgcacaccatctacatcaaggaggccgagacgaagctgctcaagcaggggaacttcaaggccctggtgaaggaccggcgcctgaacggcctcttcagcttcgtgaagaccaactccgaggccgagagcaagcggaacccgatctccaagctgcgcgtcgagtacgagctgggggagtaccaggaggcgcggatcgagatcatccaggacatgctcgccctggaggagaagctgatcaacaagtacaaggacctccccaccaacaagttcagcgagatgctgaactcctggctggagggcaaggacgaggccgacaaggcccgcttccagaacgacgtggacttcctcatcgcggtgcggaacgccttcagccacaaccagtaccccatgcacaacaagatcgagttcgccaacatcaagcccttctccctgtacaccgccaacaacagcgaggagaaggggctgggcatcgccaaccagctcaaggacaagaccaaggagacgaccgacaagatcaagaagatcgagaagccgatcgagaccaaggagtga

SEQ ID NO: 11216 - RNA, 3384 nt, synthetic construct; identical to SEQ ID NO: 11166
  misc_feature 1..3384: note = Cas13b variant__Prevotella buccae__EFU31981.1__Cas13b
  source 1..3384: mol_type = other RNA

SEQ ID NO: 11217 - RNA, 3384 nt, synthetic construct
  misc_feature 1..3384: note = Cas13b variant__Prevotella buccae__WP_004343581.1__Cas13b
  source 1..3384: mol_type = other RNA
atgcagaagcaggacaagctgttcgtggaccgcaagaagaacgccatcttcgccttccccaagtacatcaccatcatggagaaccaggagaagccggagcccatctactacgagctcaccgacaagcacttctgggcggccttcctgaacctggcccggcacaacgtctacacgaccatcaaccacatcaaccgccggctcgagatcgccgagctgaaggacgacggctacatgatggacatcaaggggagctggaacgagcaggccaagaagctggacaagaaggtgcgcctccgggacctgatcatgaagcacttccccttcctggaggcggccgcctacgagatcaccaactccaagagccccaacaacaaggagcagcgcgagaaggagcagtccgaggccctcagcctgaacaacctgaagaacgtgctgttcatcttcctggagaagctgcaggtcctccggaactactactcccactacaagtacagcgaggagtccccgaagcccatcttcgagaccagcctgctgaagaacatgtacaaggtgttcgacgcgaacgtgcgcctcgtcaagcgggactacatgcaccacgagaacatcgacatgcagcgcgacttcacgcacctgaaccggaagaagcaggtcggccgcaccaagaacatcatcgactcccccaacttccactaccacttcgccgacaaggaggggaacatgaccatcgccggcctgctgttcttcgtgagcctgttcctggacaagaaggacgccatctggatgcagaagaagctcaaggggttcaaggacggccggaacctgcgcgagcagatgaccaacgaggtgttctgccggtcccgcatcagcctgcccaagctcaagctggagaacgtgcagacgaaggactggatgcagctggacatgctcaacgagctggtgcggtgcccgaagtccctgtacgagcgcctccgggagaaggaccgcgagagcttcaaggtccccttcgacatcttctccgacgactacgacgccgaggaggagcccttcaagaacaccctggtgcggcaccaggaccgcttcccctacttcgtgctgcgctacttcgacctcaacgagatcttcgagcagctgcggttccagatcgacctgggcacctaccacttcagcatctacaacaagcgcatcggggacgaggacgaggtccggcacctcacccaccacctgtacggcttcgcgcgcatccaggacttcgcccagcagaaccagccggaggtgtggcggaagctggtgaaggacctcgactacttcgaggcctcccaggagccctacatccccaagacggcgccccactaccacctggagaacgagaagatcgggatcaagttctgcagcacccacaacaacctgttcccgtccctcaagaccgagaagacctgcaacggccgcagcaagttcaacctggggacgcagttcaccgccgaggccttcctgagcgtccacgagctcctgcccatgatgttctactacctgctgctcaccaaggactactcccggaaggagagcgccgacaaggtggagggcatcatccgcaaggagatctccaacatctacgccatctacgacgccttcgccaacggcgagatcaacagcatcgcggacctgacctgccggctgcagaagacgaacatcctccaggggcacctccccaagcagatgatctccatcctggagggccgccagaaggacatggagaaggaggccgagcggaagatcggggagatgatcgacgacacccagcgccggctcgacctgctgtgcaagcagaccaaccagaagatccgcatcggcaagcggaacgccggcctcctcaagagcgggaagatcgccgactggctggtgaacgacatgatgcgcttccagcccgtccagaaggaccagaacaacatcccgatcaacaactccaaggccaacagcaccgagtaccggatgctccagcgcgcgctggccctgttcggctccgagaacttccggctcaaggcctacttcaaccagatgaacctggtggggaacgacaacccccaccccttcctggccgagacgcagtgggagcaccagaccaacatcctcagcttctaccgcaactacctggaggcgcgcaagaagtacctgaagggcctcaagccccagaactggaagcagtaccagcacttcctgatcctgaaggtgcagaagaccaaccggaacaccctcgtcacggggtggaagaactccttcaacctgccgcgcggcatcttcacccagcccatccgggagtggttcgagaagcacaacaacagcaagcgcatctacgaccagatcctgtccttcgaccgggtgggcttcgtcgccaaggccatccccctctacttcgccgaggagtacaaggacaacgtgcagcccttctacgactacccgttcaacatcgggaacaagctgaagccccagaagggccagttcctggacaagaaggagcgcgtggagctctggcagaagaacaaggagctgttcaagaactaccccagcgagaagaagaagaccgacctggcctacctcgacttcctgtcctggaagaagttcgagcgggagctgcgcctcatcaagaaccaggacatcgtcacctggctgatgttcaaggagctgttcaacatggcgacggtggaggggctcaagatcggcgagatccacctccgggacatcgacaccaacaccgccaacgaggagagcaacaacatcctgaaccgcatcatgccgatgaagctgcccgtgaagacctacgagacggacaacaaggggaacatcctgaaggagcggcccctggccaccttctacatcgaggagaccgagaccaaggtcctcaagcagggcaacttcaaggtgctggccaaggaccgccggctgaacggcctcctgtccttcgccgagaccacggacatcgacctggagaagaaccccatcaccaagctcagcgtggaccacgagctgatcaagtaccagaccacccgcatctccatcttcgagatgacgctggggctcgagaagaagctgatcaacaagtacccgaccctgcccaccgacagcttccggaacatgctcgagcgctggctgcagtgcaaggcgaaccggcccgagctgaagaactacgtcaacagcctcatcgccgtgcgcaacgccttctcccacaaccagtaccccatgtacgacgccaccctgttcgccgaggtgaagaagttcacgctgttcccgagcgtcgacaccaagaagatcgagctcaacatcgcgccccagctgctggagatcgtgggcaaggccatcaaggagatcgagaagtccgagaacaagaactga

SEQ ID NO: 11218 - RNA, 3402 nt, synthetic construct
  misc_feature 1..3402: note = Cas13b variant__Prevotella falsenii__WP_036884929.1__Cas13b
  source 1..3402: mol_type = other RNA
atgaagaacgacaacaacagcaccaagtccaccgactacacgctgggcgacaagcacttctgggccgccttcctcaacctggcgcgccacaacgtgtacatcaccgtcaaccacatcaacaaggtgctggagctcaagaacaagaaggaccaggagatcatcatcgacaacgaccaggacatcctggccatcaagaccctgtgggggaaggtggacaccgacatcaacaagaaggaccggctccgcgagctgatcatgaagcacttccccttcctggaggccgccacgtaccagcagagctccaccaacaacaccaagcagaaggaggaggagcaggccaaggcgcagagcttcgagtccctcaaggactgcctgttcctgttcctcgagaagctgcgggaggcccgcaactactacagccactacaagcactccaagagcctggaggagccgaagctcgaggagaagctgctggagaacatgtacaacatcttcgacaccaacgtccagctcgtgatcaaggactacgagcacaacaaggacatcaaccccgaggaggacttcaagcacctgggccgggccgagggggagttcaactactacttcacgcgcaacaagaagggcaacatcaccgagtccgggctgctgttcttcgtgagcctgttcctggagaagaaggacgccatctgggcgcagaccaagatcaagggcttcaaggacaaccgggagaacaagcagaagatgacccacgaggtcttctgccgctcccggatgctcctgcccaagctgcgcctcgagagcacgcagacccaggactggatcctgctggacatgctcaacgagctgatccggtgccccaagtccctgtacaagcgcctccagggcgagaagcgggagaagttccgcgtgccgttcgaccccgccgacgaggactacgacgccgagcaggagcccttcaagaacaccctggtgcggcaccaggaccgcttcccctacttcgccctgcggtacttcgactacaacgagatcttcaccaacctccgcttccagatcgacctggggacgtaccacttcagcatctacaagaagcagatcggcgacaagaaggaggaccggcacctgacccacaagctctacgggttcgagcgcatccaggagttcgccaaggagaaccggccggacgagtggaaggcgctggtcaaggacctggacaccttcgaggagtccaacgagccctacatcagcgagaccacgccccactaccacctcgagaaccagaagatcggcatccgcaacaagaacaagaagaagaagaagaccatctggccctccctggagaccaagaccacggtgaacgagcgcagcaagtacaacctggggaagtccttcaaggccgaggccttcctcagcgtgcacgagctgctgccgatgatgttctactacctcctgctgaacaaggaggagcccaacaacggcaagatcaacgccagcaaggtcgagggcatcatcgagaagaagatccgggacatctacaagctgtacggggccttcgcgaacgaggagatcaacaacgaggaggagctcaaggagtactgcgagggcaaggacatcgccatccgccacctccccaagcagatgatcgccatcctgaagaacgagtacaaggacatggccaagaaggccgaggacaagcagaagaagatgatcaaggacaccaagaagcggctcgcggccctggacaagcaggtcaagggggaggtggaggacggcggccgcaacatcaagcccctgaagtccgggcggatcgccagctggctcgtgaacgacatgatgcgcttccagccggtgcagcgggaccgcgacggctaccccctgaacaactccaaggccaacagcaccgagtaccagctgctccagcggaccctggccctgttcgggtccgagcgcgagcggctcgcgccctacttccgccagatgaacctgatcggcaaggacaacccccacccgttcctgaaggacacgaagtggaaggagcacaacaacatcctcagcttctaccggtcctacctggaggccaagaagaacttcctggggagcctcaagcccgaggactggaagaagaaccagtacttcctgaagctgaaggagcccaagaccaaccgcgagaccctcgtgcagggctggaagaacggcttcaacctgccccgggggatcttcaccgagccgatccgcgagtggttcatccggcaccagaacgagtccgaggagtacaagaaggtcaaggacttcgaccgcatcggcctggtggccaaggtgatccccctcttcttcaaggaggactaccagaaggagatcgaggactacgtccagcccttctacgggtaccccttcaacgtgggcaacatccacaacagccaggaggggacgttcctgaacaagaaggagcgggaggagctgtggaagggcaacaagaccaagttcaaggactacaagaccaaggagaagaacaaggagaagaccaacaaggacaagttcaagaagaagacggacgaggagaaggaggagttccgctcctacctcgacttccagagctggaagaagttcgagcgcgagctgcggctggtgcgcaaccaggacatcgtcacctggctcctgtgcatggagctgatcgacaagctcaagatcgacgagctgaacatcgaggagctgcagaagctccggctgaaggacatcgacaccgacaccgccaagaaggagaagaacaacatcctgaaccgcatcatgccgatggagctccccgtgaccgtctacgagacggacgactccaacaacatcatcaaggacaagcccctgcacaccatctacatcaaggaggcggagaccaagctgctcaagcagggcaacttcaaggccctggtgaaggaccggcgcctgaacggcctcttcagcttcgtggagacctccagcgaggccgagctgaagtccaagccgatcagcaagtccctggtcgagtacgagctcggggagtaccagcgggcccgcgtggagatcatcaaggacatgctgcggctggaggagacgctcatcgggaacgacgagaagctgcccaccaacaagttccgccagatgctggacaagtggctcgagcacaagaaggagaccgacgacaccgacctgaagaacgacgtgaagctgctcacggaggtccggaacgccttcagccacaaccagtaccccatgcgcgaccggatcgcgttcgccaacatcaagcccttcagcctgtccagcgccaacacctccaacgaggagggcctggggatcgccaagaagctcaaggacaagaccaaggagaccatcgaccgcatcatcgagatcgaggagcagacggccaccaagcggtga

SEQ ID NO: 11219 - RNA, 3402 nt, synthetic construct
  misc_feature 1..3402: note = Cas13b variant__Prevotella intermedia__BAU18623.1__Cas13b
  source 1..3402: mol_type = other RNA
atggaggacgacaagaagaccaccgacagcatctcctacgagctgaaggacaagcacttctgggccgccttcctcaacctggcgcgccacaacgtgtacatcacggtcaaccacatcaacaaggtgctggagctcaagaacaagaaggaccaggacatcatcatcgacaacgaccaggacatcctggccatcaagacccactgggagaaggtgaacggcgacctgaacaagaccgagcggctccgcgagctgatgaccaagcacttccccttcctggagacggccatctacagcaagaacaaggaggacaaggaggaggtcaagcaggagaagcaggccaaggcccagtccttcgacagcctcaagcactgcctgttcctgttcctcgagaagctgcaggagacccggaactactactcccactacaagtacagcgagtccaccaaggagccgatgctggagaaggagctcctgaagaagatgtacaacatcttcgacgacaacatccagctggtgatcaaggactaccagcacaacaaggacatcaaccccgacgaggacttcaagcacctcgaccgcaccgaggaggacttcaactactacttcacgcggaacaagaaggggaacatcaccgagagcggcctgctgttcttcgtgtccctcttcctggagaagaaggacgcgatctggatgcagcagaagctgcgcgggttcaaggacaaccgggagagcaagaagaagatgacccacgaggtcttctgccgctcccggatgctcctgcccaagctgcgcctcgagagcacccagacgcaggactggatcctgctggacatgctcaacgagctgatccggtgccccaagtccctgtacgagcgcctccagggcgaggaccgggagaagttcaaggtgccgttcgaccccgccgacgaggactacgacgccgagcaggagcccttcaagaacaccctggtgcgccaccaggaccggttcccctacttcgccctgcgctacttcgactacaacgagatcttcaccaacctccggttccagatcgacctggggaccttccacttcagcatctacaagaagctgatcggcggccagaaggaggaccgccacctcacgcacaagctgtacgggttcgagcggatccaggagttcgcgaagcagaaccgcccggacgagtggaaggccatcgtcaaggacctggacacctacgagacctccaacgagcggtacatcagcgagaccacgccccactaccacctcgagaaccagaagatcggcatccgcttccgcaacgacaacgacgagatctggccctccctgaagaccaacggggagaacaacgagaagtccaagtacaagctggacaagcagtaccaggccgaggccttcctcagcgtgcacgagctgctgcccatgatgttctactacctcctgctgaagaaggaggagccgaacaacgacaagaagaacgccagcatcgtggagggcttcatcaagcgggagatccgcgacatgtacaagctgtacgacgcgttcgccaacggggagatcaacaacatcgacgacctcgagaagtactgcgaggacaagggcatccccaagcggcacctccccaagcagatggtcgccatcctgtacgacgagcacaaggacatggtgaaggaggccaagcgcaagcagcggaagatggtgaaggacaccgagaagctgctggccgcgctggagaagcagacccaggagaagacggaggacggcgggcgcaacatccggctcctcaagagcggcgagatcgcccgctggctggtcaacgacatgatgcggttccagcccgtgcagaaggacaacgaggggaacccgctgaacaactccaaggccaacagcaccgagtaccagatgctgcagcgctccctggccctctacaacaaggaggagaagcccacccggtacttccgccaggtgaacctgatcaacagctccaacccccaccccttcctgaagtggaccaagtgggaggagtgcaacaacatcctcagcttctaccggtcctacctgacgaagaagatcgagttcctgaacaagctcaagccggaggactgggagaagaaccagtacttcctgaagctgaaggagcccaagaccaaccgcgagaccctcgtccagggctggaagaacggcttcaacctgccccgggggatcttcaccgagcccatccgcgagtggttcaagcggcaccagaacgacagcaaggagtacgagaaggtggaggccctggaccgcgtgggcctcgtcacgaaggtgatcccgctgttcttcaagaaggaggactccaaggacaaggaggaggacctgaagaaggacgcgcagaaggagatcaacaactgcgtgcagcccttctacagcttcccctacaacgtcgggaacatccacaagcccgacgagaaggacttcctccaccgggaggagcgcatcgagctgtgggacaagaagaaggacaagttcaagggctacaaggccaaggtgaagtccaagaagctgaccgacaaggagaaggaggagtaccgcagctacctcgagttccagtcctggaacaagttcgagcgggagctgcgcctggtccggaaccaggacatcgtgacctggctcctgtgcaccgagctgatcgacaagctcaaggtggaggggctgaacgtcgaggagctgaagaagctccgcctgaaggacatcgacacggacaccgccaagcaggagaagaacaacatcctgaaccgggtgatgccgatgcagctccccgtgaccgtctacgagatcgacgacagccacaacatcgtgaaggaccgccccctgcacaccgtgtacatcgaggagaccaagacgaagctgctcaagcagggcaacttcaaggccctggtcaaggaccggcgcctgaacggcctcttctccttcgtggacaccagctccgaggccgagctcaagagcaacccgatctccaagagcctggtggagtacgagctgggggagtaccagaacgcgcggatcgagaccatcaaggacatgctgctgctcgaggagaccctgatcgagaagtacaagaacctgcccacggacaacttcagcgacatgctcaacggctggctggaggggaaggacgaggccgacaaggcccgcttccagaacgacgtcaagctgctcgtggccgtgcggaacgcgttctcccacaaccagtaccccatgcgcaaccggatcgccttcgccaacatcaaccccttcagcctgtccagcgccgacacctccgaggagaagaagctggacatcgccaaccagctcaaggacaagacccacaagatcatcaagcgcatcatcgagatcgagaagccgatcgagaccaaggagtga

SEQ ID NO: 11220 - RNA, 3405 nt, synthetic construct
  misc_feature 1..3405: note = Cas13b variant__Prevotella intermedia__AFJ07523.1__Cas13b
  source 1..3405: mol_type = other RNA
atgaagatggaggacgacaagaagaccaaggagagcaccaacatgctggacaacaagcacttctgggccgccttcctcaacctggcgcgccacaacgtgtacatcacggtcaaccacatcaacaaggtgctggagctcaagaacaagaaggaccaggacatcatcatcgacaacgaccaggacatcctggccatcaagacccactgggagaaggtgaacggcgacctgaacaagaccgagcggctccgcgagctgatgaccaagcacttccccttcctggagacggccatctacaccaagaacaaggaggacaaggaggaggtcaagcaggagaagcaggccaaggcccagtccttcgacagcctcaagcactgcctgttcctgttcctcgagaagctgcaggaggcgcggaactactactcccactacaagtacagcgagtccaccaaggagccgatgctggagaaggagctcctgaagaagatgtacaacatcttcgacgacaacatccagctggtgatcaaggactaccagcacaacaaggacatcaaccccgacgaggacttcaagcacctcgaccgcaccgaggaggagttcaactactacttcacgaccaacaagaaggggaacatcaccgccagcggcctgctgttcttcgtgtccctcttcctggagaagaaggacgccatctggatgcagcagaagctgcgggggttcaaggacaaccgcgagagcaagaagaagatgacccacgaggtcttctgccggtcccgcatgctcctgcccaagctgcggctcgagagcacgcagacccaggactggatcctgctggacatgctcaacgagctgatccgctgccccaagtccctgtacgagcggctccagggcgagtaccgcaagaagttcaacgtgccgttcgacagcgccgacgaggactacgacgcggagcaggagcccttcaagaacaccctggtgcggcaccaggaccgcttcccctacttcgccctgcggtacttcgactacaacgagatcttcaccaacctccgcttccagatcgacctggggacgtaccacttctccatctacaagaagctgatcggcggccagaaggaggaccggcacctcacccacaagctgtacgggttcgagcgcatccaggagttcgccaagcagaaccggaccgacgagtggaaggccatcgtcaaggacttcgacacctacgagacgagcgaggagccctacatctccgagaccgccccgcactaccacctggagaaccagaagatcggcatccgcttccggaacgacaacgacgagatctggcccagcctcaagaccaacggggagaacaacgagaagcgcaagtacaagctggacaagcagtaccaggcggaggccttcctgtccgtgcacgagctcctgcccatgatgttctactacctgctcctgaagaaggaggagcccaacaacgacaagaagaacgccagcatcgtggagggcttcatcaagcgcgagatccgggacatctacaagctgtacgacgccttcgccaacggggagatcaacaacatcgacgacctggagaagtactgcgaggacaagggcatcccgaagcgccacctccccaagcagatggtcgcgatcctgtacgacgagcacaaggacatggccgaggaggccaagcggaagcagaaggagatggtgaaggacaccaagaagctgctcgccacgctggagaagcagacccagggcgagatcgaggacgggggccgcaacatccggctgctcaagtccggggagatcgcccgctggctggtgaacgacatgatgcggttccagcccgtccagaaggacaacgagggcaaccccctgaacaacagcaaggcgaacagcaccgagtaccagatgctccagcgctccctggccctgtacaacaaggaggagaagccgacccggtacttccgccaggtgaacctcatcaacagctccaacccccaccccttcctgaagtggacgaagtgggaggagtgcaacaacatcctgagcttctaccggtcctacctcaccaagaagatcgagttcctgaacaagctgaagcccgaggactgggagaagaaccagtacttcctcaagctgaaggagccgaagaccaaccgcgagaccctggtgcagggctggaagaacgggttcaacctcccccggggcatcttcacggagcccatccgcgagtggttcaagcggcaccagaacgacagcgaggagtacgagaaggtcgagaccctggaccgcgtggggctggtgaccaaggtcatccccctcttcttcaagaaggaggactccaaggacaaggaggagtacctgaagaaggacgcccagaaggagatcaacaactgcgtgcagccgttctacggcttcccctacaacgtggggaacatccacaagcccgacgagaaggacttcctgcccagcgaggagcggaagaagctctggggcgacaagaagtacaagttcaagggctacaaggccaaggtcaagtccaagaagctgaccgacaaggagaaggaggagtaccgcagctacctggagttccagtcctggaacaagttcgagcgggagctccgcctggtgcgcaaccaggacatcgtcacgtggctgctctgcaccgagctgatcgacaagctgaaggtggaggggctcaacgtggaggagctgaagaagctgcggctcaaggacatcgacaccgacaccgccaagcaggagaagaacaacatcctgaaccgcgtcatgccgatgcagctgcccgtgaccgtgtacgagatcgacgacagccacaacatcgtcaaggaccggcccctccacacggtgtacatcgaggagaccaagaccaagctgctgaagcagggcaacttcaaggcgctcgtgaaggaccgccggctgaacgggctgttctccttcgtcgacaccagctccgagacggagctcaagagcaacccgatctccaagagcctggtggagtacgagctgggcgagtaccagaacgcccgcatcgagaccatcaaggacatgctcctgctggaggagaccctcatcgagaagtacaagaccctgcccacggacaacttctccgacatgctgaacgggtggctcgagggcaaggacgaggccgacaaggcccggttccagaacgacgtgaagctgctggtcgcggtgcgcaacgccttcagccacaaccagtaccccatgcggaaccgcatcgccttcgccaacatcaaccccttcagcctctccagcgccgacacctccgaggagaagaagctggacatcgcgaaccagctgaaggacaagacccacaagatcatcaagcggatcatcgagatcgagaagccgatcgagaccaaggagtga

SEQ ID NO: 11221 - RNA, 3399 nt, synthetic construct
  misc_feature 1..3399: note = Cas13b variant__Prevotella intermedia__WP_014708441.1__Cas13b
  source 1..3399: mol_type = other RNA
atggaggacgacaagaagaccaaggagagcaccaacatgctggacaacaagcacttctgggccgccttcctcaacctggcgcgccacaacgtgtacatcacggtcaaccacatcaacaaggtgctggagctcaagaacaagaaggaccaggacatcatcatcgacaacgaccaggacatcctggccatcaagacccactgggagaaggtgaacggcgacctgaacaagaccgagcggctccgcgagctgatgaccaagcacttccccttcctggagacggccatctacaccaagaacaaggaggacaaggaggaggtcaagcaggagaagcaggccaaggcccagtccttcgacagcctcaagcactgcctgttcctgttcctcgagaagctgcaggaggcgcggaactactactcccactacaagtacagcgagtccaccaaggagccgatgctggagaaggagctcctgaagaagatgtacaacatcttcgacgacaacatccagctggtgatcaaggactaccagcacaacaaggacatcaaccccgacgaggacttcaagcacctcgaccgcaccgaggaggagttcaactactacttcacgaccaacaagaaggggaacatcaccgccagcggcctgctgttcttcgtgtccctcttcctggagaagaaggacgccatctggatgcagcagaagctgcgggggttcaaggacaaccgcgagagcaagaagaagatgacccacgaggtcttctgccggtcccgcatgctcctgcccaagctgcggctcgagagcacgcagacccaggactggatcctgctggacatgctcaacgagctgatccgctgccccaagtccctgtacgagcggctccagggcgagtaccgcaagaagttcaacgtgccgttcgacagcgccgacgaggactacgacgcggagcaggagcccttcaagaacaccctggtgcggcaccaggaccgcttcccctacttcgccctgcggtacttcgactacaacgagatcttcaccaacctccgcttccagatcgacctggggacgtaccacttctccatctacaagaagctgatcggcggccagaaggaggaccggcacctcacccacaagctgtacgggttcgagcgcatccaggagttcgccaagcagaaccggaccgacgagtggaaggccatcgtcaaggacttcgacacctacgagacgagcgaggagccctacatctccgagaccgccccgcactaccacctggagaaccagaagatcggcatccgcttccggaacgacaacgacgagatctggcccagcctcaagaccaacggggagaacaacgagaagcgcaagtacaagctggacaagcagtaccaggcggaggccttcctgtccgtgcacgagctcctgcccatgatgttctactacctgctcctgaagaaggaggagcccaacaacgacaagaagaacgccagcatcgtggagggcttcatcaagcgcgagatccgggacatctacaagctgtacgacgccttcgccaacggggagatcaacaacatcgacgacctggagaagtactgcgaggacaagggcatcccgaagcgccacctccccaagcagatggtcgcgatcctgtacgacgagcacaaggacatggccgaggaggccaagcggaagcagaaggagatggtgaaggacaccaagaagctgctcgccacgctggagaagcagacccagggcgagatcgaggacgggggccgcaacatccggctgctcaagtccggggagatcgcccgctggctggtgaacgacatgatgcggttccagcccgtccagaaggacaacgagggcaaccccctgaacaacagcaaggcgaacagcaccgagtaccagatgctccagcgctccctggccctgtacaacaaggaggagaagccgacccggtacttccgccaggtgaacctcatcaacagctccaacccccaccccttcctgaagtggacgaagtgggaggagtgcaacaacatcctgagcttctaccggtcctacctcaccaagaagatcgagttcctgaacaagctgaagcccgaggactgggagaagaaccagtacttcctcaagctgaaggagccgaagaccaaccgcgagaccctggtgcagggctggaagaacgggttcaacctcccccggggcatcttcacggagcccatccgcgagtggttcaagcggcaccagaacgacagcgaggagtacgagaaggtcgagaccctggaccgcgtggggctggtgaccaaggtcatccccctcttcttcaagaaggaggactccaaggacaaggaggagtacctgaagaaggacgcccagaaggagatcaacaactgcgtgcagccgttctacggcttcccctacaacgtggggaacatccacaagcccgacgagaaggacttcctgcccagcgaggagcggaagaagctctggggcgacaagaagtacaagttcaagggctacaaggccaaggtcaagtccaagaagctgaccgacaaggagaaggaggagtaccgcagctacctggagttccagtcctggaacaagttcgagcgggagctccgcctggtgcgcaaccaggacatcgtcacgtggctgctctgcaccgagctgatcgacaagctgaaggtggaggggctcaacgtggaggagctgaagaagctgcggctcaaggacatcgacaccgacaccgccaagcaggagaagaacaacatcctgaaccgcgtcatgccgatgcagctgcccgtgaccgtgtacgagatcgacgacagccacaacatcgtcaaggaccggcccctccacacggtgtacatcgaggagaccaagaccaagctgctgaagcagggcaacttcaaggcgctcgtgaaggaccgccggctgaacgggctgttctccttcgtcgacaccagctccgagacggagctcaagagcaacccgatctccaagagcctggtggagtacgagctgggcgagtaccagaacgcccgcatcgagaccatcaaggacatgctcctgctggaggagaccctcatcgagaagtacaagaccctgcccacggacaacttctccgacatgctgaacgggtggctcgagggcaaggacgaggccgacaaggcccggttccagaacgacgtgaagctgctggtcgcggtgcgcaacgccttcagccacaaccagtaccccatgcggaaccgcatcgccttcgccaacatcaaccccttcagcctctccagcgccgacacctccgaggagaagaagctggacatcgcgaaccagctgaaggacaagacccacaagatcatcaagcggatcatcgagatcgagaagccgatcgagaccaaggagtga

SEQ ID NO: 11222 - RNA, 3381 nt, synthetic construct
  misc_feature 1..3381: note = Cas13b variant__Prevotella intermedia__WP_036860899.1__Cas13b
  source 1..3381: mol_type = other RNA
atggaggacgacaagaagaccaccgacagcatccgctacgagctgaaggacaagcacttctgggccgccttcctcaacctggcgcggcacaacgtgtacatcacggtcaaccacatcaacaagatcctggaggagggcgagatcaaccgcgacgggtacgagaccaccctcaagaacacctggaacgagatcaaggacatcaacaagaaggaccggctgtccaagctgatcatcaagcacttccccttcctcgaggccgccacgtaccgcctgaacccgaccgacaccaccaagcagaaggaggagaagcaggccgaggcccagagcctggagtccctccgcaagagcttcttcgtgttcatctacaagctgcgggacctgcggaaccactactcccactacaagcacagcaagtccctcgagcgccccaagttcgaggagggcctgctggagaagatgtacaacatcttcaacgcgagcatccggctcgtgaaggaggactaccagtacaacaaggacatcaaccccgacgaggacttcaagcacctggaccgcacggaggaggagttcaactactacttcaccaaggacaacgaggggaacatcaccgagtccggcctcctcttcttcgtcagcctgttcctggagaagaaggacgccatctggatgcagcagaagctccgggggttcaaggacaaccgcgagaacaagaagaagatgaccaacgaggtgttctgccggtcccgcatgctgctgcccaagctccggctgcagagcacgcagacccaggactggatcctgctcgacatgctgaacgagctgatccgctgcccgaagtccctctacgagcggctgcgcgaggaggaccgggagaagttccgcgtgcccatcgagatcgccgacgaggactacgacgccgagcaggagcccttcaagaacaccctggtccggcaccaggaccgcttcccctacttcgcgctccgctacttcgactacaacgagatcttcaccaacctgcggttccagatcgacctgggcacgtaccacttcagcatctacaagaagcagatcggcgactacaaggagtcccaccacctcacccacaagctgtacgggttcgagcgcatccaggagttcaccaagcagaaccggccggacgagtggcgcaagttcgtgaagaccttcaacagcttcgagacgtccaaggagccctacatccccgagaccacgccccactaccacctggagaaccagaagatcggcatccggttccgcaacgacaacgacaagatctggccgagcctcaagaccaactccgagaagaacgagaagtccaagtacaagctggacaagagcttccaggccgaggccttcctgagcgtgcacgagctcctgcccatgatgttctactacctgctcctgaagaccgagaacaccgacaacgacaacgagatcgagaccaagaagaaggagaacaagaacgacaagcaggagaagcacaagatcgaggagatcatcgagaacaagatcaccgagatctacgccctgtacgacacgttcgccaacggggagatcaagagcatcgacgagctcgaggagtactgcaagggcaaggacatcgagatcgggcacctccccaagcagatgatcgcgatcctgaaggacgagcacaaggtcatggccaccgaggccgagcggaagcaggaggagatgctggtggacgtgcagaagtccctggagagcctggacaaccagatcaacgaggagatcgagaacgtcgagcgcaagaactccagcctgaagtccggcaagatcgccagctggctcgtgaacgacatgatgcggttccagcccgtgcagaaggacaacgagggcaagccgctgaacaactccaaggccaacagcaccgagtaccagctgctccagcgcaccctggcgttcttcgggtccgagcacgagcggctggccccctacttcaagcagacgaagctcatcgagagctccaacccccaccccttcctgaaggacaccgagtgggagaagtgcaacaacatcctgagcttctaccgctcctacctcgaggccaagaagaacttcctggagagcctgaagccggaggactgggagaagaaccagtacttcctcaagctgaaggagcccaagaccaagcccaagaccctggtccagggctggaagaacgggttcaacctcccccggggcatcttcacggagccgatccgcaagtggttcatgaagcaccgggagaacatcaccgtggccgagctgaagcgcgtgggcctggtcgccaaggtgatccccctcttcttctccgaggagtacaaggacagcgtgcagcccttctacaactaccacttcaacgtcgggaacatcaacaagcccgacgagaagaacttcctgaactgcgaggagcggcgcgagctgctccggaagaagaaggacgagttcaagaagatgaccgacaaggagaaggaggagaacccgtcctacctggagttcaagagctggaacaagttcgagcgcgagctgcgcctcgtgcggaaccaggacatcgtgacctggctgctgtgcatggagctgttcaacaagaagaagatcaaggagctgaacgtcgagaagatctacctgaagaacatcaacaccaacacgaccaagaaggagaagaacaccgaggagaagaacggcgaggagaagaacatcaaggagaagaacaacatcctcaaccgcatcatgcccatgcggctgcccatcaaggtgtacgggcgcgagaacttcagcaagaacaagaagaagaagatccggcgcaacaccttcttcacggtctacatcgaggagaagggcaccaagctgctcaagcaggggaacttcaaggcgctggagcgggaccgccggctgggcggcctcttctccttcgtgaagaccccgagcaaggccgagtccaagagcaacaccatctccaagctgcgcgtggagtacgagctgggggagtaccagaaggcccggatcgagatcatcaaggacatgctcgccctggagaagacgctgatcgacaagtacaacagcctcgacaccgacaacttcaacaagatgctgaccgactggctggagctcaagggcgagcccgacaaggcctccttccagaacgacgtcgacctgctgatcgcggtgcgcaacgccttcagccacaaccagtaccccatgcggaaccgcatcgccttcgccaacatcaaccccttctccctcagctccgcgaacaccagcgaggagaaggggctgggcatcgccaaccagctgaaggacaagacgcacaagaccatcgagaagatcatcgagatcgagaagccgatcgagaccaaggagtga

SEQ ID NO: 11223 - RNA, 3363 nt, synthetic construct
  misc_feature 1..3363: note = Cas13b variant__Prevotella intermedia__WP_061868553.1__Cas13b
  source 1..3363: mol_type = other RNA
atggaggacgacaagaagaccaccgacagcatccgctacgagctgaaggacaagcacttctgggccgccttcctcaacctggcgcggcacaacgtgtacatcacggtcaaccacatcaacaagatcctggaggaggacgagatcaaccgcgacggctacgagaacaccctcgagaactcctggaacgagatcaaggacatcaacaagaaggaccggctgagcaagctgatcatcaagcacttccccttcctcgaggccaccacctaccgccagaacccgacggacaccaccaagcagaaggaggagaagcaggccgaggcccagtccctggagagcctgaagaagtccttcttcgtgttcatctacaagctccgggacctgcgcaaccactacagccactacaagcactccaagagcctggagcggcccaagttcgaggaggacctccagaacaagatgtacaacatcttcgacgtgtccatccagttcgtcaaggaggactacaagcacaacaccgacatcaaccccaagaaggacttcaagcacctggaccgcaagcggaaggggaagttccactacagcttcgccgacaacgagggcaacatcacggagtccgggctcctgttcttcgtgagcctgttcctggagaagaaggacgcgatctgggtgcagaagaagctcgagggcttcaagtgctccaacaagagctaccagaagatgaccaacgaggtcttctgccgctcccggatgctgctgcccaagctccgcctggagagcacccagacccaggactggatcctgctcgacatgctgaacgagctgatccggtgcccgaagtccctctacgagcgcctgcagggggtgaaccggaagaagttctacgtgagcttcgaccccgccgacgaggactacgacgccgagcaggagcccttcaagaacacgctggtccgccaccaggaccggttcccctacttcgccctccgctacttcgactacaacgaggtgttcgcgaacctgcggttccagatcgacctgggcacctaccacttctccatctacaagaagctcatcggcgggcagaaggaggaccgccacctgacccacaagctgtacggcttcgagcggatccaggagttcgacaagcagaaccgcccggacgagtggaaggccatcgtgaaggacagcgacaccttcaagaagaaggaggagaaggaggaggagaagccctacatcagcgagacgacgccccactaccacctcgagaacaagaagatcgggatcgccttcaagaaccacaacatctggccctccacccagaccgagctgaccaacaacaagcgcaagaagtacaacctgggcaccagcatcaaggccgaggccttcctctccgtccacgagctgctgccgatgatgttctactacctcctgctgaagaccgagaacaccaagaacgacaacaaggtcgggggcaagaaggagacgaagaagcagggcaagcacaagatcgaggcgatcatcgagagcaagatcaaggacatctacgccctctacgacgccttcgccaacggggagatcaactccgaggacgagctgaaggagtacctgaagggcaaggacatcaagatcgtgcacctccccaagcagatgatcgccatcctgaagaacgagcacaaggacatggcggagaaggccgaggccaagcaggagaagatgaagctggccaccgagaaccggctgaagaccctcgacaagcagctgaaggggaagatccagaacggcaagcgctacaacagcgcccccaagtccggcgagatcgcgagctggctggtgaacgacatgatgcggttccagcccgtgcagaaggacgagaacggggagtccctcaacaacagcaaggccaactccaccgagtaccagctgctgcagcgcacgctcgccttcttcggcagcgagcacgagcggctggccccgtacttcaagcagaccaagctgatcgagtccagcaacccccaccccttcctcaacgacaccgagtgggagaagtgctccaacatcctgagcttctaccgctcctacctgaaggcccggaagaacttcctcgagagcctgaagcccgaggactgggagaagaaccagtacttcctgatgctcaaggagccgaagaccaaccgcgagacgctggtgcaggggtggaagaacggcttcaacctgccccgggggttcttcaccgagcccatccgcaagtggttcatggagcactggaagtccatcaaggtcgacgacctcaagcgggtgggcctggtggcgaaggtcacgcccctgttcttcagcgagaagtacaaggacagcgtgcagccgttctacaactaccccttcaacgtgggcgacgtcaacaagcccaaggaggaggacttcctccaccgcgaggagcggatcgagctgtgggacaagaagaaggacaagttcaaggggtacaaggccaagaagaagttcaaggagatgaccgacaaggagaaggaggagcaccgctcctacctggagttccagagctggaacaagttcgagcgggagctccgcctggtgcggaaccaggacatcgtcacctggctgctctgcaccgagctgatcgacaagctgaagatcgacgagctcaacatcaaggagctgaagaagctgcgcctcaaggacatcaacaccgacaccgccaagaaggagaagaacaacatcctgaaccgggtgatgcccatggagctgccggtgaccgtctacaaggtgaacaagggcgggtacatcatcaagaacaagcccctccacacgatctacatcaaggaggccgagaccaagctgctgaagcagggcaacttcaaggcgctcgtgaaggaccgccgcctgaacgggctgttctccttcgtcaagacccccagcgaggccgagtccgagagcaacccgatctccaagctccgggtggagtacgagctgggcaagtaccagaacgcccgcctggacatcatcgaggacatgctcgccctggagaagaagctgatcgacaagtacaacagcctcgacaccgacaacttccacaacatgctgacgggctggctggagctcaagggggaggccaagaaggcgcggttccagaacgacgtgaagctgctgaccgccgtccgcaacgccttctcccacaaccagtaccccatgtacgacgagaacctcttcggcaacatcgagcggttcagcctgtccagctccaacatcatcgagagcaaggggctggacatcgccgccaagctcaaggaggaggtgtccaaggcggccaagaagatccagaacgaggaggacaacaagaaggagaaggagacctga

SEQ ID NO: 11224 - RNA, 3378 nt, synthetic construct
  misc_feature 1..3378: note = Cas13b variant__Prevotella intermedia__KJJ86756.1__Cas13b
  source 1..3378: mol_type = other RNA
atgaagatggaggacgacaagaagaccaccgagagcacgaacatgctggacaacaagcacttctgggccgccttcctcaacctggcgcgccacaacgtgtacatcaccgtcaaccacatcaacaaggtgctggagctcaagaacaagaaggaccaggacatcatcatcgacaacgaccaggacatcctggccatcaagacccactgggagaaggtgaacggcgacctgaacaagaccgagcggctccgcgagctgatgacgaagcacttccccttcctggagaccgccatctacaccaagaacaaggaggacaaggaggaggtcaagcaggagaagcaggccgaggcccagtccctcgagagcctgaaggactgcctgttcctcttcctggagaagctgcaggaggcgcggaactactactcccactacaagtacagcgagtccaccaaggagccgatgctcgaggaggggctgctggagaagatgtacaacatcttcgacgacaacatccagctcgtgatcaaggactaccagcacaacaaggacatcaaccccgacgaggacttcaagcacctggaccgcaagggccagttcaagtacagcttcgccgacaacgaggggaacatcacggagtccggcctcctcttcttcgtgagcctgttcctggagaagaaggacgccatctggatgcagcagaagctcaccgggttcaaggacaaccgggagtccaagaagaagatgacccacgaggtcttctgccgccggcgcatgctgctgcccaagctccggctggagagcacccagacgcaggactggatcctgctcgacatgctgaacgagctgatccgctgccccaagtccctctacgagcggctgcagggcgagtaccgcaagaagttcaacgtgccgttcgacagcgccgacgaggactacgacgcggagcaggagcccttcaagaacaccctggtgcggcaccaggaccgcttcccctacttcgccctccggtacttcgactacaacgagatcttcaccaacctgcgcttccagatcgacctgggcacctaccacttctccatctacaagaagctcatcgggggccagaaggaggaccggcacctgacgcacaagctgtacgggttcgagcgcatccaggagttcgccaagcagaaccggcccgacgagtggaaggccctcgtcaaggacctggacacctacgagaccagcaacgagcgctacatctccgagaccacgccgcactaccacctggagaaccagaagatcggcatccggttccgcaacgggaacaaggagatctggcccagcctcaagaccaacggcgagaacaacgagaagtccaagtacaagctggacaagccctaccaggccgaggcgttcctgagcgtgcacgagctcctgcccatgatgttctactacctgctgctcaagaaggaggagccgaacaacgacaagaagaacgcctccatcgtggagggcttcatcaagcgcgagatccgggacatgtacaagctgtacgacgccttcgccaacggggagatcaacaacatcggcgacctggagaagtactgcgaggacaaggggatccccaagcgccacctccccaagcagatggtcgccatcctgtacgacgagcccaaggacatggtgaaggaggcgaagcggaagcagaaggagatggtgaaggacaccaagaagctgctcgccaccctggagaagcagacgcaggaggagatcgaggacggcggccgcaacatccggctgctcaagagcggggagatcgcccgctggctggtcaacgacatgatgcggttccagccggtgcagaaggacaacgagggcaaccccctgaacaacagcaaggccaactccaccgagtaccagatgctccagcgcagcctggccctgtacaacaaggaggagaagcccacccggtacttccgccaggtgaacctcatcaactccagcaacccccacccgttcctgaagtggaccaagtgggaggagtgcaacaacatcctgtccttctaccggaactacctcacgaagaagatcgagttcctgaacaagctgaagcccgaggactgggagaagaaccagtacttcctcaagctgaaggagcccaagaccaaccgcgagaccctggtccaggggtggaagaacggcttcaacctcccccgggggatcttcaccgagccgatccgcgagtggttcaagcggcaccagaacgacagcaaggagtacgagaaggtggaggcgctgaagcgcgtgggcctggtcacgaaggtgatccccctcttcttcaaggaggagtacttcaaggaggacgcccagaaggagatcaacaactgcgtgcagcccttctactccttcccctacaacgtcggcaacatccacaagccggacgagaaggacttcctgcccagcgaggagcggaagaagctgtggggcgacaagaaggacaagttcaaggggtacaaggccaaggtgaagtccaagaagctcaccgacaaggagaaggaggagtaccgcagctacctggagttccagtcctggaacaagttcgagcgggagctgcgcctcgtccgcaaccaggacatcgtgacctggctgctgtgcaccgagctcatcgacaagatgaaggtggaggggctgaacgtcgaggagctgcagaagctccggctgaaggacatcgacacggacaccgccaagcaggagaagaacaacatcctgaaccgcatcatgcccatgcagctcccggtgaccgtgtacgagatcgacgacagccacaacatcgtcaaggaccggcccctgcacaccgtgtacatcgaggagaccaagacgaagctgctcaagcagggcaacttcaaggccctggtgaaggaccgccggctgaacgggctgttctccttcgtcgacaccagctccaaggcggagctgaaggacaagcccatcagcaagtccgtggtggagtacgagctgggcgagtaccagaacgcccgcatcgagaccatcaaggacatgctcctgctggagaagaccctcatcaagaagtacgagaagctgcccacggacaacttcagcgacatgctgaacggctggctcgaggggaaggacgagtccgacaaggcccggttccagaacgacgtcaagctgctggtggccgtgcgcaacgcgttcagccacaaccagtacccgatgcggaaccgcatcgccttcgccaacatcaaccccttcagcctctccagcgccgacatctccgaggagaagaagctggacatcgccaaccagctgaaggacaagacccacaagatcatcaagaagatcatcgagatcgagaagcccatcgagaccaaggagtga

SEQ ID NO: 11225 - RNA, 3378 nt, synthetic construct
  misc_feature 1..3378: note = Cas13b variant__Prevotella pallens__EGQ18444.1__Cas13b
  source 1..3378: mol_type = other RNA
atgaaggaggaggagaagggcaagacccccgtggtcagcacctacaacaaggacgacaagcacttctgggccgccttcctgaacctcgcgcgccacaacgtgtacatcacggtgaaccacatcaacaagatcctgggggagggcgagatcaaccgggacgggtacgagaacaccctggagaagtcctggaacgagatcaaggacatcaacaagaaggaccgcctcagcaagctgatcatcaagcacttcccgttcctggaggtcaccacctaccagcggaactccgccgacacgaccaagcagaaggaggagaagcaggccgaggcccagagcctcgagtccctgaagaagtccttcttcgtgttcatctacaagctgcgcgacctccggaaccactacagccactacaagcacagcaagtccctggagcgccccaagttcgaggaggacctgcaggagaagatgtacaacatcttcgacgccagcatccagctcgtgaaggaggactacaagcacaacaccgacatcaagaccgaggaggacttcaagcacctggaccggaagggccagttcaagtactccttcgcggacaacgaggggaacatcacggagagcggcctgctgttcttcgtctccctgttcctggagaagaaggacgccatctgggtgcagaagaagctcgagggcttcaagtgcagcaacgagtcctaccagaagatgaccaacgaggtgttctgccgcagccggatgctgctgcccaagctccgcctgcagtccacccagacccaggactggatcctgctcgacatgctgaacgagctgatccggtgccccaagagcctctacgagcgcctgcgggaggaggaccgcaagaagttccgggtcccgatcgagatcgccgacgaggactacgacgccgagcaggagcccttcaagaacgcgctggtgcgccaccaggaccggttcccctacttcgccctccgctacttcgactacaacgagatcttcacgaacctgcggttccagatcgacctggggacctaccacttctccatctacaagaagcagatcggcgactacaaggagagccaccacctcacccacaagctgtacgggttcgagcgcatccaggagttcaccaagcagaaccggcccgacgagtggcgcaagttcgtgaagacgttcaacagcttcgagacctccaaggagccgtacatccccgagaccacgccccactaccacctggagaaccagaagatcggcatccgcttccggaacgacaacgacaagatctggcccagcctcaagaccaactccgagaagaacgagaagtccaagtacaagctggacaagagcttccaggccgaggccttcctgagcgtccacgagctcctgccgatgatgttctactacctgctcctgaagaccgagaacaccgacaacgacaacgagatcgagaccaagaagaaggagaacaagaacgacaagcaggagaagcacaagatcgaggagatcatcgagaacaagatcacggagatctacgccctgtacgacgcgttcgccaacgggaagatcaactccatcgacaagctcgaggagtactgcaagggcaaggacatcgagatcggccacctccccaagcagatgatcgccatcctcaagagcgagcacaaggacatggccaccgaggccaagcgcaagcaggaggagatgctcgcggacgtgcagaagtccctggagagcctggacaaccagatcaacgaggagatcgagaacgtggagcggaagaactccagcctgaagtccggggagatcgccagctggctcgtcaacgacatgatgcgcttccagcccgtgcagaaggacaacgagggcaaccccctgaacaactccaaggccaacagcaccgagtaccagatgctgcagcggtccctcgccctgtacaacaaggaggagaagccgacccgctacttccgccaggtgaacctgatcgagagctccaacccccaccccttcctcaacaacacggagtgggagaagtgcaacaacatcctgagcttctaccggagctacctggaggccaagaagaacttcctcgagtccctgaagcccgaggactgggagaagaaccagtacttcctgatgctcaaggagccgaagaccaactgcgagaccctggtccaggggtggaagaacggcttcaacctgccccggggcatcttcaccgagcccatccgcaagtggttcatggagcaccggaagaacatcacggtggcggagctcaagcgcgtggggctggtcgccaaggtgatccccctgttcttcagcgaggagtacaaggactccgtgcagccgttctacaactacctcttcaacgtcggcaacatcaacaagcccgacgagaagaacttcctgaactgcgaggagcggcgcgagctgctccggaagaagaaggacgagttcaagaagatgaccgacaaggagaaggaggagaaccccagctacctggagttccagtcctggaacaagttcgagcgcgagctgcggctcgtgcgcaaccaggacatcgtcacctggctgctgtgcatggagctgttcaacaagaagaagatcaaggagctgaacgtggagaagatctacctgaagaacatcaacaccaacacgaccaagaaggagaagaacaccgaggagaagaacggggaggagaagatcatcaaggagaagaacaacatcctcaaccggatcatgcccatgcgcctgccgatcaaggtgtacggccgcgagaacttcagcaagaacaagaagaagaagatccggcgcaacaccttcttcaccgtctacatcgaggagaaggggacgaagctgctcaagcagggcaacttcaaggccctggagcgggaccgccggctgggcggcctcttctccttcgtgaagacccacagcaaggccgagtccaagagcaacaccatctccaagagccgcgtggagtacgagctgggggagtaccagaaggcccggatcgagatcatcaaggacatgctggcgctcgaggagaccctgatcgacaagtacaactccctggacacggacaacttccacaacatgctcaccgggtggctgaagctgaaggacgagcccgacaaggccagcttccagaacgacgtcgacctcctgatcgccgtgcgcaacgccttctcccacaaccagtaccccatgcggaaccgcatcgcgttcgccaacatcaacccgttcagcctgtccagcgccaacaccagcgaggagaagggcctcgggatcgccaaccagctgaaggacaagacccacaagacgatcgagaagatcatcgagatcgagaagcccatcgagaccaaggagtga

SEQ ID NO: 11226 - RNA, 3453 nt, synthetic construct
  misc_feature 1..3453: note = Cas13b variant__Prevotella saccharolytica__EKY00089.1__Cas13b
  source 1..3453: mol_type = other RNA
atgatggagaaggagaacgtgcagggcagccacatctactacgagcccaccgacaagtgcttctgggccgccttctacaacctggcgcgccacaacgcctacctcaccatcgcccacatcaactccttcgtcaacagcaagaaggggatcaacaacgacgacaaggtgctggacatcatcgacgactggtccaagttcgacaacgacctgctcatgggcgcccggctgaacaagctgatcctcaagcacttcccgttcctgaaggcgcccctgtaccagctcgccaagcgcaagacgcggaagcagcaggggaaggagcagcaggactacgagaagaagggcgacgaggaccccgaggtgatccaggaggccatcgccaacgccttcaagatggcgaacgtccgcaagaccctgcacgccttcctgaagcagctcgaggacctgcggaaccacttcagccactacaactacaactcccccgccaagaagatggaggtgaagttcgacgacgggttctgcaacaagctgtactacgtgttcgacgccgccctccagatggtcaaggacgacaaccgcatgaacccggagatcaacatgcagaccgacttcgagcacctggtgcggctgggccgcaaccggaagatccccaacaccttcaagtacaacttcacgaacagcgacggcaccatcaacaacaacgggctcctgttcttcgtgtccctgttcctcgagaagcgcgacgcgatctggatgcagaagaagatcaagggcttcaagggcgggaccgagaactacatgcggatgaccaacgaggtcttctgccgcaaccggatggtgatccccaagctgcgcctggagacggactacgacaaccaccagctcatgttcgacatgctgaacgagctggtgcggtgccccctcagcctgtacaagcgcctgaagcaggaggaccaggacaagttccgggtcccgatcgagttcctcgacgaggacaacgaggccgacaacccctaccaggagaacgccaactccgacgagaaccccaccgaggagaccgaccccctgaagaacaccctggtgcgccaccagcaccggttcccgtacttcgtgctccgctacttcgacctgaacgaggtcttcaagcagctgcggttccagatcaacctcgggtgctaccacttcagcatctacgacaagacgatcggcgagcgcaccgagaagcgccacctgacccggaccctgttcggcttcgaccgcctccagaacttctccgtgaagctgcagcccgagcactggaagaacatggtgaagcacctggacacggaggagagctccgacaagccctacctcagcgacgccatgccccactaccagatcgagaacgagaagatcgggatccacttcctgaagaccgacaccgagaagaaggagaccgtctggccgtccctggaggtggaggaggtgagctccaaccggaacaagtacaagagcgagaagaacctcacggccgacgcgttcctgtccacccacgagctgctccccatgatgttctactaccagctgctgagcagcgaggagaagacccgcgccgccgccggcgacaaggtccagggggtgctgcagtcctaccggaagaagatcttcgacatctacgacgacttcgccaacggcaccatcaacagcatgcagaagctcgacgagcgcctggcgaaggacaacctgctccggggcaacatgccccagcagatgctggccatcctggagcaccaggagcccgacatggagcagaaggccaaggagaagctcgaccgcctgatcacggagaccaagaagcggatcgggaagctggaggaccagttcaagcagaaggtgcgcatcggcaagcggcgcgccgacctcccgaaggtcgggtccatcgccgactggctggtgaacgacatgatgcggttccagcccgcgaagcgcaacgccgacaacaccggcgtccccgacagcaaggccaactccaccgagtaccggctgctccaggaggccctggcgttctacagcgcctacaaggaccgcctggagccctacttccgccaggtgaacctcatcgggggcacgaacccgcaccccttcctgcaccgggtggactggaagaagtgcaaccacctcctgtccttctaccacgactacctggaggccaaggagcagtacctgagccacctctcccccgccgactggcagaagcaccagcacttcctgctgctcaaggtccggaaggacatccagaacgagaagaaggactggaagaagtccctggtggccggctggaagaacgggttcaacctgccccgcggcctcttcaccgagagcatcaagacctggttcagcaccgacgcggacaaggtgcagatcacggacaccaagctgttcgagaaccgcgtcgggctgatcgccaagctcatcccgctgtactacgacaaggtgtacaacgacaagccccagcccttctaccagtacccgttcaacatcaacgaccggtacaagcccgaggacacccgcaagcggttcaccgccgcctccagcaagctgtggaacgagaagaagatgctctacaagaacgcccagcccgactccagcgacaagatcgagtacccccagtacctggacttcctgtcctggaagaagctcgagcgcgagctgcggatgctgcgcaaccaggacatgatggtgtggctcatgtgcaaggacctgttcgcgcagtgcacggtcgagggcgtggagttcgccgacctgaagctcagccagctggaggtggacgtcaacgtgcaggacaacctgaacgtgctcaacaacgtctccagcatgatcctgccgctgagcgtgtacccctccgacgcccaggggaacgtgctccggaacagcaagcccctgcacaccgtctacgtgcaggagaacaacaccaagctgctcaagcagggcaacttcaagtccctgctgaaggaccgccggctcaacggcctgttcagcttcatcgccgccgagggggaggacctgcagcagcaccccctcaccaagaaccgcctggagtacgagctgtccatctaccagaccatgcggatcagcgtgttcgagcagacgctccagctggagaaggcgatcctgacccgcaacaagaccctctgcggcaacaacttcaacaacctgctgaactcctggagcgagcaccggaccgacaagaagacgctccagccggacatcgacttcctgatcgccgtccgcaacgccttctcccacaaccagtaccccatgagcaccaacaccgtgatgcaggggatcgagaagttcaacatccagacccccaagctggaggagaaggacggcctcgggatcgcctcccagctggcgaagaagacgaaggacgccgccagccggctgcagaacatcatcaacggcggcaccaactga

SEQ ID NO: 11227 - RNA, 3969 nt, synthetic construct
  misc_feature 1..3969: note = Cas13b variant__Prevotella sp.__WP_036929175.1__Cas13b
  source 1..3969: mol_type = other RNA
atgagcaaggagtgcaagaagcagcgccaggagaagaagcggcgcctgcagaaggccaacttctccatcagcctgaccggcaagcacgtgttcggggcctacttcaacatggcgcggaccaacttcgtcaagacgatcaactacatcctgcccatcgccggcgtgcgcgggaactactccgagaaccagatcaacaagatgctgcacgccctcttcctgatccaggccggccggaacgaggagctgaccaccgagcagaagcagtgggagaagaagctccgcctgaacccggagcagcagaccaagttccagaagctgctgttcaagcacttccccgtgctggggcccatgatggccgacgtcgcggaccacaaggcctacctgaacaagaagaagtccacggtgcagaccgaggacgagaccttcgccatgctcaagggcgtgagcctggccgactgcctggacatcatctgcctcatggcggacaccctgacggagtgccggaacttctacacccacaaggacccctacaacaagccgagccagctggccgaccagtacctccaccaggagatgatcgccaagaagctggacaaggtcgtggtggcctcccgccggatcctgaaggaccgcgagggcctcagcgtcaacgaggtggagttcctgaccgggatcgaccacctccaccaggaggtgctcaaggacgagttcggcaacgccaaggtcaaggacgggaaggtgatgaagaccttcgtggagtacgacgacttctacttcaagatctccggcaagcggctggtcaacgggtacacggtgaccaccaaggacgacaagcccgtgaacgtcaacaccatgctgcccgcgctcagcgacttcggcctgctgtacttctgcgtgctgttcctgtccaagccctacgccaagctgttcatcgacgaggtgcgcctcttcgagtacagcccgttcgacgacaaggagaacatgatcatgtccgagatgctgagcatctaccggatccgcacgccccggctgcacaagatcgactcccacgacagcaaggccaccctcgccatggacatcttcggcgagctgcgccggtgccccatggagctgtacaacctcctggacaagaacgccgggcagcccttcttccacgacgaggtcaagcacccgaactcccacacccccgacgtgagcaagcgcctgcggtacgacgaccgcttccccaccctcgcgctgcggtacatcgacgagacggagctgttcaagcgcatccgcttccagctccagctgggctccttccggtacaagttctacgacaaggagaactgcatcgacgggcgcgtgcgggtccgccggatccagaaggagatcaacggctacggccgcatgcaggaggtggccgacaagcggatggacaagtggggcgacctgatccagaagcgcgaggagcggagcgtcaagctcgagcacgaggagctgtacatcaacctggaccagttcctggaggacaccgccgacagcaccccctacgtgaccgaccgccggccggcctacaacatccacgccaaccgcatcgggctctactgggaggactcccagaaccccaagcagtacaaggtgttcgacgagaacgggatgtacatccccgagctggtcgtgacggaggacaagaaggcgcccatcaagatgccggcgccccggtgcgccctgagcgtgtacgacctccccgccatgctgttctacgagtacctgcgcgagcagcaggacaacgagttcccctccgccgagcaggtcatcatcgagtacgaggacgactaccggaagttcttcaaggccgtggccgagggcaagctcaagccgttcaagcgccccaaggagttccgggacttcctgaagaaggagtaccccaagctgcgcatggccgacatccccaagaagctccagctgttcctgtgcagccacgggctctgctacaacaacaagccggagaccgtgtacgagcggctggaccgcctgaccctccagcacctggaggagcgcgagctgcacatccagaaccggctcgagcactaccagaaggaccgcgacatgatcggcaacaaggacaaccagtacggcaagaagtccttcagcgacgtccggcacggggccctggcgcgctacctggcccagtccatgatggagtggcagcccaccaagctcaaggacaaggagaagggccacgacaagctgacggggctgaactacaacgtgctcaccgcctacctggccacctacggccacccccaggtgccggaggaggggttcacgccccggaccctggagcaggtcctcatcaacgcccacctgatcggcggcagcaacccccaccccttcatcaacaaggtgctggcgctcgggaaccgcaacatcgaggagctgtacctgcactacctcgaggaggagctgaagcacatccggtcccgcatccagagcctgtccagcaacccgtccgacaaggccctcagcgccctgcccttcatccaccacgaccggatgcgctaccacgagcggacctccgaggagatgatggccctggccgcgcgctacaccaccatccagctccccgacggcctgttcacgccctacatcctggagatcctccagaagcactacaccgagaacagcgacctgcagaacgccctgtcccaggacgtgccggtcaagctcaacccgacctgcaacgccgcctacctgatcaccctgttctaccagaccgtgctcaaggacaacgcccagcccttctacctgagcgacaagacgtacacccggaacaaggacggggagaaggcggagtccttcagcttcaagcgcgcctacgagctgttcagcgtgctcaacaacaacaagaaggacaccttccccttcgagatgatccccctgttcctgacctccgacgagatccaggagcggctcagcgccaagctgctggacggcgacgggaaccccgtccccgaggtgggcgagaagggcaagcccgccacggactcccaggggaacaccatctggaagcgccggatctacagcgaggtggacgactacgcggagaagctcaccgaccgcgacatgaagatctccttcaagggcgagtgggagaagctgccgcggtggaagcaggacaagatcatcaagcgccgggacgagacccgccgccagatgcgggacgagctgctccagcgcatgccccggtacatccgcgacatcaaggacaacgagcggacgctgcgccggtacaagacccaggacatggtcctgttcctcctggccgagaagatgttcaccaacatcatcagcgagcagtccagcgagttcaactggaagcagatgcgcctgtccaaggtgtgcaacgaggccttcctccggcagaccctgacgttccgcgtgcccgtcaccgtgggggagaccaccatctacgtggagcaggagaacatgagcctgaagaactacggcgagttctaccggttcctcacggacgaccgcctgatgtccctgctcaacaacatcgtcgagaccctgaagcccaacgagaacggcgacctggtgatccggcacaccgacctcatgagcgagctggccgcctacgaccagtaccgctccaccatcttcatgctgatccagagcatcgagaacctcatcatcacgaacaacgcggtgctggacgacccggacgccgacgggttctgggtccgggaggacctgcccaagcgcaacaacttcgcctccctcctggagctgatcaaccagctcaacaacgtggagctgaccgacgacgagcggaagctgctcgtggccatccgcaacgccttcagccacaactcctacaacatcgacttcagcctgatcaaggacgtcaagcacctccccgaggtggcgaagggcatcctccagcacctccagagcatgctgggggtggagatcaccaagtga

SEQ ID NO: 11228 - RNA, 3384 nt, synthetic construct
  misc_feature 1..3384: note = Cas13b variant__Prevotella sp.__WP_007412163.1__Cas13b
  source 1..3384: mol_type = other RNA
atgcagaagcaggacaagctgttcgtggaccgcaagaagaacgccatcttcgccttccccaagtacatcaccatcatggagaaccaggagaagccggagcccatctactacgagctcaccgacaagcacttctgggcggccttcctgaacctggcccggcacaacgtctacacgaccatcaaccacatcaaccgccggctcgagatcgccgagctgaaggacgacggctacatgatggggatcaagggcagctggaacgagcaggccaagaagctggacaagaaggtgcgcctccgggacctgatcatgaagcacttccccttcctggaggcggccgcctacgagatcaccaacagcaagagccccaacaacaaggagcagcgcgagaaggagcagtccgaggccctcagcctgaacaacctgaagaacgtgctgttcatcttcctggagaagctgcaggtcctccggaactactactcccactacaagtacagcgaggagtccccgaagcccatcttcgagaccagcctgctgaagaacatgtacaaggtgttcgacgcgaacgtgcgcctcgtcaagcgggactacatgcaccacgagaacatcgacatgcagcgcgacttcacgcacctgaaccggaagaagcaggtcgggcgcaccaagaacatcatcgactcccccaacttccactaccacttcgccgacaaggagggcaacatgaccatcgccgggctgctgttcttcgtgagcctgttcctggacaagaaggacgccatctggatgcagaagaagctcaagggcttcaaggacggccggaacctgcgcgagcagatgaccaacgaggtgttctgccggtcccgcatcagcctgcccaagctcaagctggagaacgtgcagacgaaggactggatgcagctggacatgctcaacgagctggtgcggtgcccgaagtccctgtacgagcgcctccgggagaaggaccgcgagagcttcaaggtccccttcgacatcttctccgacgactacgacgccgaggaggagcccttcaagaacaccctggtgcggcaccaggaccgcttcccctacttcgtgctgcgctacttcgacctcaacgagatcttcgagcagctgcggttccagatcgacctggggacctaccacttcagcatctacaacaagcgcatcggcgacgaggacgaggtccggcacctcacccaccacctgtacgggttcgcgcgcatccaggacttcgccccgcagaaccagcccgaggagtggcggaagctggtgaaggacctcgaccacttcgagacgtcccaggagccctacatcagcaagaccgcgccccactaccacctggagaacgagaagatcggcatcaagttctgctccacccacaacaacctgttcccgagcctcaagcgcgagaagacctgcaacgggcggagcaagttcaacctgggcacgcagttcaccgccgaggccttcctgtccgtgcacgagctcctgcccatgatgttctactacctgctgctcaccaaggactacagccgcaaggagtccgccgacaaggtcgagggcatcatccggaaggagatcagcaacatctacgccatctacgacgccttcgccaacaacgagatcaactccatcgccgacctgacctgccgcctgcagaagacgaacatcctccaggggcacctccccaagcagatgatcagcatcctggagggccggcagaaggacatggagaaggaggcggagcgcaagatcggggagatgatcgacgacacccagcggcgcctcgacctgctgtgcaagcagaccaaccagaagatccggatcggcaagcgcaacgccggcctcctgaagtccgggaagatcgccgactggctggtgagcgacatgatgcggttccagcccgtgcagaaggacaccaacaacgccccgatcaacaactccaaggccaacagcacggagtaccgcatgctccagcacgcgctggccctgttcggctccgagagctcccggctcaaggcctacttccgccagatgaacctggtcgggaacgccaacccccaccccttcctggcggagacccagtgggagcaccagaccaacatcctcagcttctaccgcaactacctggaggcccggaagaagtacctgaagggcctcaagccccagaactggaagcagtaccagcacttcctgatcctgaaggtgcagaagaccaaccgcaacacgctcgtgaccgggtggaagaactccttcaacctgccgcggggcatcttcacccagcccatccgcgagtggttcgagaagcacaacaacagcaagcggatctacgaccagatcctgtccttcgaccgcgtcggcttcgtggccaaggccatccccctctacttcgccgaggagtacaaggacaacgtccagcccttctacgactacccgttcaacatcgggaacaagctgaagccccagaagggccagttcctggacaagaaggagcgggtggagctctggcagaagaacaaggagctgttcaagaactaccccagcgagaagaacaagaccgacctggcgtacctcgacttcctgtcctggaagaagttcgagcgcgagctgcggctcatcaagaaccaggacatcgtgacgtggctgatgttcaaggagctgttcaagaccaccaccgtcgaggggctcaagatcggcgagatccacctccgcgacatcgacacgaacaccgccaacgaggagagcaacaacatcctgaaccggatcatgccgatgaagctccccgtgaagacctacgagaccgacaacaaggggaacatcctgaaggagcgccccctggccaccttctacatcgaggagacggagaccaaggtgctcaagcagggcaacttcaaggtcctggccaaggaccggcgcctgaacggcctcctgagcttcgccgagaccaccgacatcgacctggagaagaaccccatcacgaagctctccgtggactacgagctgatcaagtaccagaccacccggatcagcatcttcgagatgaccctggggctcgagaagaagctgatcgacaagtactccacgctgccgaccgacagcttccgcaacatgctcgagcggtggctgcagtgcaaggcgaaccgccccgagctgaagaactacgtgaactccctcatcgccgtccggaacgccttcagccacaaccagtaccccatgtacgacgccaccctgttcgccgaggtgaagaagttcaccctgttcccctccgtggacacgaagaagatcgagctcaacatcgcgccgcagctgctggagatcgtcggcaaggccatcaaggagatcgagaagtccgagaacaagaactga

SEQ ID NO: 11229 - RNA, 3273 nt, synthetic construct
  misc_feature 1..3273: note = Cas13b variant__Prevotella sp.__WP_044072147.1__Cas13b
  source 1..3273: mol_type = other RNA
atgaacatccccgccctggtggagaaccagaagaagtacttcggcacctacagcgtcatggccatgctcaacgcgcagaccgtgctggaccacatccagaaggtggccgacatcgagggggagcagaacgagaacaacgagaacctgtggttccacccggtcatgtcccacctctacaacgccaagaacggctacgacaagcagcccgagaagacgatgttcatcatcgagcgcctgcagagctacttccccttcctgaagatcatggccgagaaccagcgggagtactccaacgggaagtacaagcagaaccgcgtggaggtgaacagcaacgacatcttcgaggtcctcaagcgggccttcggcgtgctgaagatgtaccgcgaccaggcgtcccactacaagacctacgacgagaagctgatcgacgggtgcgagttcctcaccagcaccgagcagcccctgtccggcatgatcaacaactactacacggtggccctgcggaacatgaacgagcgctacggctacaagaccgaggacctcgccttcatccaggacaagcggttcaagttcgtcaaggacgcctacgggaagaagaagtcccaggtgaacaccggcttcttcctgagcctgcaggactacaacggggacacccagaagaagctccacctgagcggcgtggggatcgcgctgctcatctgcctgttcctggacaagcagtacatcaacatcttcctctcccgcctgccgatcttcagctcctacaacgcccagagcgaggagcggcgcatcatcatccggtccttcggcatcaacagcatcaagcagcccaaggaccgcatccactccgagaagtccaacaagagcgtcgccatggacatgctgaacgagatcaagcggtgccccaacgagctgttcgagacgctgagcgccgagaagcagagccgcttccggatcatctccaacgaccacaacgaggtgctgatgaagcgcagctccgaccggttcgtgcccctcctgctgcagtacatcgactacggcaagctgttcgaccacatccgcttccacgtcaacatggggaagctccggtacctgctcaaggccgacaagacctgcatcgacggccagacccgcgtgcgggtgatcgagcagccgctgaacgggttcggccgcctggaggaggtcgagaccatgcgcaagcaggagaacggcacgttcgggaacagcggcatccggatccgcgacttcgagaacatgaagcgggacgacgcgaaccccgccaactacccctacatcgtggacacctacacccactacatcctcgagaacaacaaggtggagatgttcatctccgacgaggagacccccgccccgctgctgcccgtcatcgaggacgaccgctacgtggtgaagacgatccccagctgccggatgtccaccctcgagatccccgccatggccttccacatgttcctgttcgggagcaagaagaccgagaagctgatcgtcgacgtgcacaaccgctacaagcgcctcttcaaggcgatgcagaaggaggaggtcaccgccgagaacatcgcctccttcggcatcgccgagagcgacctgccgcagaagatcatcgacctgatctccgggaacgcccacggcaaggacgtggacgcgttcatccggctcacggtggacgacatgctggccgacaccgagcggcgcatcaagcggttcaaggacgaccgcaagagcatccggtccgccgacaacaagatgggcaagcgcgggttcaagcagatcagcaccggcaagctggccgacttcctcgccaaggacatcgtcctgttccagccctccgtgaacgacggggagaacaagatcaccggcctgaactaccggatcatgcagagcgcgatcgccgtgtacaactccggggacgactacgaggccaagcagcagttcaagctgatgttcgagaaggcccgcctcatcggcaagggcacgaccgagccccaccccttcctgtacaaggtcttcgtgcggagcatcccggcgaacgccgtggacttctacgagcgctacctgatcgagcggaagttctacctcatcgggctgtccaacgagatcaagaagggcaaccgcgtcgacgtgcccttcatccgccgggaccagaacaagtggaagacccccgccatgaagaccctggggcgcatctacgacgaggacctccccgtggagctgccgcggcagatgttcgacaacgagatcaagagccacctcaagagcctcccccagatggagggcatcgacttcaacaacgccaacgtcacgtacctgatcgccgagtacatgaagcgcgtgctgaacgacgacttccagaccttctaccagtggaagcggaactaccgctacatggacatgctccgcggggagtacgaccggaagggctccctgcagagctgcttcacctccgtggaggagcgggagggcctgtggaaggagcgcgcgagccggaccgagcgctaccggaagctcgcctccaacaagatccgcagcaaccggcagatgcgcaacgcctccagcgaggagatcgagacgatcctggacaagcggctgtccaacagccgcaacgagtaccagaagtccgagaaggtcatccggcgctaccgggtgcaggacgccctcctgttcctgctcgccaagaagaccctgaccgagctggcggacttcgacggggagcgcttcaagctcaaggagatcatgcccgacgccgagaagggcatcctgagcgagatcatgcccatgtccttcaccttcgagaagggcgggaagaagtacacgatcaccagcgagggcatgaagctgaagaactacggggacttcttcgtgctcgcctccgacaagcgcatcggcaacctgctggagctcgtcgggagcgacaccgtgtccaaggaggacatcatggaggagttcaagaagtacgaccagtgccggccggagatcagcagcatcgtgttcaacctggagaagtgggccttcgacacctaccccgagctgtccgcccgcgtcgaccgggaggagaaggtggacttcaagagcatcctcaagatcctgctgaacaacaagaacatcaacaaggagcagtccgacatcctccgcaagatccggaacgcgttcgaccacaacaactaccccgacaagggcgtggtcgagatccgcgccctgccggagatcgccatgagcatcaagaaggccttcggggagtacgcgatcatgaagtga

SEQ ID NO: 11230 - RNA, 3273 nt, synthetic construct
  misc_feature 1..3273: note = Cas13b variant__Prevotella sp.__WP_042518169.1__Cas13b
  source 1..3273: mol_type = other RNA
atgaacatccccgccctggtggagaaccagaagaagtacttcggcacctacagcgtcatggccatgctcaacgcgcagaccgtgctggaccacatccagaaggtggccgacatcgagggggagcagaacgagaacaacgagaacctgtggttccacccggtcatgtcccacctctacaacgccaagaacggctacgacaagcagcccgagaagacgatgttcatcatcgagcgcctgcagagctacttccccttcctgaagatcatggccgagaaccagcgggagtactccaacgggaagtacaagcagaaccgcgtggaggtgaacagcaacgacatcttcgaggtcctcaagcgggccttcggcgtgctgaagatgtaccgcgacctgaccaaccactacaagacctacgaggagaagctcatcgacgggtgcgagttcctgacctccacggagcagcccctgagcggcatgatctccaagtactacaccgtggcgctccggaacaccaaggagcgctacggctacaagaccgaggacctggccttcatccaggacaacatcaagaagatcacgaaggacgcctacgggaagcgcaagagccaggtcaacaccggcttcttcctgtccctccaggactacaacggggacacccagaagaagctgcacctgagcggcgtggggatcgccctcctgatctgcctgttcctcgacaagcagtacatcaacatcttcctgtcccggctgccgatcttcagctcctacaacgcgcagagcgaggagcggcgcatcatcatccggtccttcggcatcaacagcatcaagctccccaaggaccgcatccactccgagaagtccaacaagagcgtggccatggacatgctgaacgaggtcaagcggtgccccgacgagctgttcaccacgctcagcgccgagaagcagagccgcttccggatcatctccgacgaccacaacgaggtgctgatgaagcgcagcaccgaccggttcgtgcccctgctcctgcagtacatcgactacggcaagctgttcgaccacatccgcttccacgtcaacatggggaagctccggtacctgctgaaggccgacaagacctgcatcgacggccagacccgcgtgcgggtgatcgagcagccgctcaacgggttcggccgcctggaggaggccgagacgatgcgcaagcaggagaacggcaccttcgggaactccggcatccggatccgcgacttcgagaacgtcaagcgggacgacgcgaaccccgccaactacccctacatcgtggacacctacacccactacatcctggagaacaacaaggtggagatgttcatcagcgacaaggggtccagcgcgcccctcctgccgctgatcgaggacgaccgctacgtcgtgaagacgatcccctcctgccggatgagcaccctcgagatccccgccatggccttccacatgttcctgttcggctccaagaagaccgagaagctgatcgtggacgtccacaaccgctacaagcgcctcttccaggccatgcagaaggaggaggtgaccgccgagaacatcgccagcttcgggatcgccgagtccgacctgccccagaagatcctggacctcatcagcggcaacgcccacggcaaggacgtcgacgcgttcatccggctgacggtggacgacatgctgaccgacaccgagcggcgcatcaagcggttcaaggacgaccgcaagtccatccggagcgccgacaacaagatggggaagcgcggcttcaagcagatctccaccgggaagctggccgacttcctcgccaaggacatcgtgctgttccagccgagcgtcaacgacggcgagaacaagatcacggggctgaactaccggatcatgcagtccgccatcgcggtgtacgacagcggcgacgactacgaggccaagcagcagttcaagctcatgttcgagaaggcccgcctgatcggcaaggggaccaccgagccccaccccttcctgtacaaggtgttcgcccggtccatccccgcgaacgccgtcgacttctacgagcgctacctcatcgagcggaagttctacctgaccggcctgtgcaacgagatcaagcgcgggaaccgcgtggacgtgccgttcatccggcgcgaccagaacaagtggaagacgcccgccatgaagaccctcggccggatctacagcgaggacctgcccgtcgagctgccccgccagatgttcgacaacgagatcaagagccacctcaagtccctgccgcagatggaggggatcgacttcaacaacgccaacgtgacctacctgatcgccgagtacatgaagcgggtgctcaacgacgacttccagaccttctaccagtggaagcgcaactaccactacatggacatgctgaagggcgagtacgaccggaagggcagcctgcagcactgcttcacgtccgtcgaggagcgcgaggggctctggaaggagcgggcgagccgcaccgagcggtaccgcaagctggcctccaacaagatccggagcaaccgccagatgcggaacgcctccagcgaggagatcgagaccatcctggacaagcgcctctccaactgccggaacgagtaccagaagtccgagaaggtgatccgccggtaccgcgtgcaggacgccctgctgttcctcctggccaagaagaccctgaccgagctcgcggacttcgacggcgagcggttcaagctgaaggagatcatgcccgacgccgagaaggggatcctgagcgagatcatgcccatgagcttcacgttcgagaagggcggcaagaagtacaccatcacctccgaggggatgaagctcaagaactacggcgacttcttcgtcctggccagcgacaagcgcatcgggaacctgctcgagctggtgggctccgacatcgtgagcaaggaggacatcatggaggagttcaacaagtacgaccagtgccgccccgagatctccagcatcgtcttcaacctggagaagtgggccttcgacacctacccggagctcagcgcccgggtggaccgcgaggagaaggtggacttcaagtccatcctgaagatcctgctcaacaacaagaacatcaacaaggagcagagcgacatcctgcggaagatccgcaacgcgttcgaccacaacaactaccccgacaaggggatcgtcgagatcaaggccctgcccgagatcgccatgtccatcaagaaggccttcggcgagtacgcgatcatgaagtga

SEQ ID NO: 11231 - RNA, 3273 nt, synthetic construct
  misc_feature 1..3273: note = Cas13b variant__Prevotella sp.__WP_044074780.1__Cas13b
  source 1..3273: mol_type = other RNA
atgaacatccccgccctggtggagaaccagaagaagtacttcggcacctacagcgtcatggccatgctcaacgcgcagaccgtgctggaccacatccagaaggtggccgacatcgagggggagcagaacgagaacaacgagaacctgtggttccacccggtcatgtcccacctctacaacgccaagaacggctacgacaagcagcccgagaagacgatgttcatcatcgagcgcctgcagagctacttccccttcctgaagatcatggccgagaaccagcgggagtactccaacgggaagtacaagcagaaccgcgtggaggtgaacagcaacgacatcttcgaggtcctcaagcgggccttcggcgtgctgaagatgtaccgcgacctgaccaaccactacaagacctacgaggagaagctcatcgacgggtgcgagttcctgacctccacggagcagcccttcagcggcatgatctccaagtactacaccgtggcgctgcggaacaccaaggagcgctacggctacaaggccgaggacctcgccttcatccaggacaaccggtacaagttcaccaaggacgcctacgggaagcgcaagagccaggtcaacacgggctccttcctgagcctgcaggactacaacggggacaccaccaagaagctccacctgtccggcgtggggatcgcgctgctcatctgcctgttcctggacaagcagtacatcaacctcttcctgagccggctgccgatcttctccagctacaacgcccagtccgaggagcgccggatcatcatccgcagcttcggcatcaactccatcaagcagcccaaggaccggatccacagcgagaagtccaacaagagcgtggccatggacatgctcaacgaggtcaagcgctgccccgacgagctgttcaccacgctgagcgccgagaagcagtcccggttccgcatcatcagcgacgaccacaacgaggtgctcatgaagcggtccagcgaccgcttcgtgcccctgctgctccagtacatcgactacggcaagctgttcgaccacatccggttccacgtcaacatggggaagctgcgctacctcctgaaggccgacaagacctgcatcgacggccagacccgggtgcgcgtgatcgagcagccgctgaacgggttcggccgcctcgaggaggtcgagaccatgcggaagcaggagaacggcacgttcgggaactccggcatccgcatccgggacttcgagaacatgaagcgcgacgacgcgaaccccgccaactacccctacatcgtggagacctacacccactacatcctggagaacaacaaggtggagatgttcatcagcgacgaggagaaccccaccccgctgctccccgtcatcgaggacgaccggtacgtggtgaagacgatcccctcctgccgcatgagcaccctggagatccccgccatggccttccacatgttcctgttcgggtccgagaagaccgagaagctcatcatcgacgtccacgaccggtacaagcgcctgttccaggccatgcagaaggaggaggtgaccgcggagaacatcgccagcttcggcatcgccgagtccgacctgccgcagaagatcatggacctcatcagcgggaacgcccacggcaaggacgtcgacgccttcatccggctgacggtggacgacatgctgaccgacaccgagcgccggatcaagcgcttcaaggacgaccggaagtccatccgcagcgcggacaacaagatgggcaagcgggggttcaagcagatctccaccggcaagctcgccgacttcctggccaaggacatcgtgctgttccagcccagcgtcaacgacggggagaacaagatcacgggcctgaactaccgcatcatgcagtccgccatcgccgtgtacgacagcggggacgactacgaggcgaagcagcagttcaagctcatgttcgagaaggcccggctgatcggcaagggcaccaccgagccccaccccttcctgtacaaggtgttcgtccgctccatcccggccaacgccgtggacttctacgagcggtacctcatcgagcgcaagttctacctgatcgggctgagcaacgagatcaagaagggcaaccgcgtggacgtccccttcatccggcgcgaccagaacaagtggaagacccccgcgatgaagacgctcgggcggatctacagcgaggacctgcccgtggagctgccgcgccagatgttcgacaacgagatcaagtcccacctcaagagcctgccccagatggagggcatcgacttcaacaacgccaacgtgacctacctgatcgccgagtacatgaagcgggtcctcaacgacgacttccagaccttctaccagtggaagcgcaactaccggtacatggacatgctgcgcggggagtacgaccggaagggctccctgcagcactgcttcaccagcatcgaggagcgcgagggcctctggaaggagcgggcctcccgcacggagcggtaccgcaagctggccagcaacaagatccggtccaaccgccagatgcggaacgcgagctccgaggagatcgagaccatcctggacaagcgcctcagcaactgccggaacgagtaccagaagtccgagaagatcatccgccggtaccgcgtgcaggacgccctgctgttcctcctggccaagaagaccctgaccgagctcgccgacttcgacggggagcgcttcaagctgaaggagatcatgcccgacgccgagaagggcatcctgagcgagatcatgcccatgtccttcaccttcgagaagggcgggaagatctacacgatcaccagcggcgggatgaagctcaagaactacggcgacttcttcgtgctggcgtccgacaagcggatcgggaacctgctcgagctggtcggcagcaacaccgtgtccaaggaggacatcatggaggagttcaagaagtacgaccagtgccgcccggagatcagcagcatcgtgttcaacctggagaagtgggccttcgacacctaccccgagctccccgcccgggtcgaccgcaaggagaaggtggacttctggtccatcctggacgtgctgagcaacaacaaggacatcaacaacgagcagtcctacatcctccggaagatccgcaacgccttcgaccacaacaactacccggacaaggggatcgtcgagatcaaggccctgcccgagatcgcgatgagcatcaagaaggccttcggcgagtacgccatcatgaagtga

SEQ ID NO: 11232 - RNA, 3438 nt, synthetic construct
  misc_feature 1..3438: note = Cas13b variant__Psychroflexus torquis__WP_015024765.1__Cas13b
  source 1..3438: mol_type = other RNA
atggagagcatcatcggcctggggctctccttcaacccctacaagaccgccgacaagcactacttcggcagcttcctgaacctggtggagaacaacctcaacgccgtcttcgcggagttcaaggagcgcatctcctacaaggccaaggacgagaacatcagctccctgatcgagaagcacttcatcgacaacatgagcatcgtggactacgagaagaagatctccatcctgaacgggtacctcccgatcatcgacttcctggacgacgagctggagaacaacctcaacacccgggtgaagaacttcaagaagaacttcatcatcctggccgaggccatcgagaagctgcgcgactactacacgcacttctaccacgaccccatcaccttcgaggacaacaaggagcccctcctggagctgctcgacgaggtcctgctgaagaccatcctcgacgtgaagaagaagtacctgaagaccgacaagacgaaggagatcctgaaggacagcctccgggaggagatggacctgctggtgatccgcaagaccgacgagctccgggagaagaagaagaccaaccccaagatccagcacaccgactccagccagatcaagaactccatcttcaacgacgccttccagggcctgctgtacgaggacaaggggaacaacaagaagacgcaggtcagccaccgcgcgaagacccggctcaacccgaaggacatccacaagcaggaggagcgcgacttcgagatccccctgtccaccagcggcctggtgttcctcatgtccctgttcctgagcaagaaggagatcgaggacttcaagtccaacatcaagggcttcaaggggaaggtggtcaaggacgagaaccacaacagcctcaagtacatggccacccaccgggtgtactccatcctggccttcaagggcctgaagtaccgcatcaagacggacaccttcagcaaggagaccctcatgatgcagatgatcgacgagctgagcaaggtgcccgactgcgtctaccagaacctgtccgagaccaagcagaaggacttcatcgaggactggaacgagtacttcaaggacaacgaggagaacacggagaacctcgagaacagccgggtggtgcaccccgtcatccgcaagcggtacgaggacaagttcaactacttcgccatccgcttcctggacgagttcgcgaacttcaagaccctgaagttccaggtgttcatggggtactacatccacgaccagcggaccaagaccatcggcacgaccaacatcaccaccgagcgcacggtgaaggagaagatcaacgtcttcgggaagctctccaagatggacaacctgaagaagcacttcttcagccagctgtccgacgacgagaacaccgactgggagttcttcccgaaccccagctacaacttcctcacccaggccgacaactcccccgccaacaacatccccatctacctggagctgaagaaccagcagatcatcaaggagaaggacgccatcaaggccgaggtgaaccagacccagaaccggaacccgaacaagcccagcaagcgcgacctcctgaacaagatcctgaagacgtacgaggacttccaccagggcgaccccaccgcgatcctgtccctcaacgagatccccgccctgctgcacctcttcctggtgaagccgaacaacaagaccggccagcagatcgagaacatcatccggatcaagatcgagaagcagttcaaggccatcaaccaccccagcaagaacaacaaggggatccccaagtccctgttcgccgacaccaacgtccgcgtgaacgccatcaagctcaagaaggacctggaggcggagctggacatgctcaacaagaagcacatcgccttcaaggagaaccagaaggccagctccaactacgacaagctgctgaaggagcaccagttcacgcccaagaacaagcggccggagctccgcaagtacgtgttctacaagagcgagaagggcgaggaggccacctggctggccaacgacatcaagcgcttcatgcccaaggacttcaagaccaagtggaaggggtgccagcactccgagctgcagcggaagctcgcgttctacgaccgccacaccaagcaggacatcaaggagctgctgagcggctgcgagttcgaccactccctcctggacatcaacgcctacttccagaaggacaacttcgaggacttcttcagcaagtacctggagaaccggatcgagacgctcgagggcgtcctgaagaagctgcacgacttcaagaacgagcccacgcccctcaagggggtgttcaagaactgcttcaagttcctgaagcgccagaactacgtcaccgagtccccggagatcatcaagaagcggatcctggccaagcccaccttcctcccccgcggcgtgttcgacgagcggcccaccatgaagaaggggaagaacccgctgaaggacaagaacgagttcgccgagtggttcgtggagtacctggagaacaaggactaccagaagttctacaacgccgaggagtaccgcatgcgggacgcggacttcaagaagaacgccgtcatcaagaagcagaagctcaaggacttctacaccctgcagatggtgaactacctgctcaaggaggtgttcggcaaggacgagatgaacctgcagctgagcgagctgttccagacccgccaggagcggctcaagctgcaggggatcgccaagaagcagatgaacaaggagaccggcgacagctccgagaacacccgcaaccagacgtacatctggaacaaggacgtccccgtgagcttcttcaacggcaaggtgaccatcgacaaggtcaagctcaagaacatcgggaagtacaagcggtacgagcgcgacgagcgggtgaagaccttcatcggctacgaggtggacgagaagtggatgatgtacctgccccacaactggaaggaccgctactccgtcaagccgatcaacgtgatcgacctgcagatccaggagtacgaggagatccggagccacgagctcctgaaggagatccagaacctggagcagtacatctacgaccacaccacggacaagaacatcctcctgcaggacgggaaccccaacttcaagatgtacgtgctgaacggcctcctgatcgggatcaagcaggtcaacatccccgacttcatcgtgctgaagcagaacaccaacttcgacaagatcgacttcaccggcatcgcctcctgcagcgagctcgagaagaagaccatcatcctgatcgcgatccgcaacaagttcgcccacaaccagctgcccaacaagatgatctacgacctcgccaacgagttcctgaagatcgagaagaacgagacgtacgccaactactacctgaaggtgctcaagaagatgatctccgacctggcctga

SEQ ID NO: 11233 - RNA, 2847 nt, synthetic construct
  misc_feature 1..2847: note = Cas13b variant__Riemerella anatipestifer__WP_049354263.1__Cas13b
  source 1..2847: mol_type = other RNA
atgttcttcagcttccacaacgcccagcgcgtgatcttcaagcacctgtacaaggccttcgacgcgtccctccggatggtcaaggaggactacaaggcccacttcaccgtgaacctgacccgcgacttcgcccacctgaaccggaagggcaagaacaagcaggacaaccccgacttcaaccgctaccggttcgagaaggacgggttcttcacggagagcggcctcctgttcttcaccaacctgttcctcgacaagcgcgacgcctactggatgctgaagaaggtgtccgggttcaaggccagccacaagcagcgggagaagatgaccaccgaggtcttctgccgctcccggatcctgctcccgaagctgcgcctggagagccggtacgaccacaaccagatgctcctggacatgctgtccgagctcagccgctgccccaagctgctgtacgagaagctctccgaggagaacaagaagcacttccaggtggaggcggacggcttcctggacgagatcgaggaggagcagaaccccttcaaggacacgctgatccggcaccaggaccgcttcccctacttcgccctccggtacctggacctgaacgagagcttcaagtccatccgcttccaggtggacctcgggacctaccactactgcatctacgacaagaagatcggcgacgagcaggagaagcggcacctgacccgcaccctgctcagcttcggccggctgcaggacttcacggagatcaaccgcccgcaggagtggaaggccctgaccaaggacctcgactacaaggagacctccaaccagcccttcatcagcaagaccacgccccactaccacatcaccgacaacaagatcgggttccggctgggcacctccaaggagctgtaccccagcctcgagatcaaggacggggccaaccgcatcgcgaagtacccgtacaactccggcttcgtcgcccacgccttcatcagcgtgcacgagctgctgcccctcatgttctaccagcacctgaccgggaagtccgaggacctgctcaaggagacggtgcgccacatccagcggatctacaaggacttcgaggaggagcgcatcaacaccatcgaggacctggagaaggccaaccagggccggctgcccctcggcgccttccccaagcagatgctggggctgctccagaacaagcagccggacctgagcgagaaggcgaagatcaagatcgagaagctgatcgccgagaccaagctcctgagccaccgcctgaacaccaagctgaagtccagccccaagctcggcaagcggcgcgagaagctgatcaagacgggggtcctggccgactggctcgtgaaggacttcatgcggttccagcccgtggcctacgacgcccagaaccagcccatcaagtccagcaaggcgaactccaccgagttctggttcatccgccgggccctggccctgtacggcggcgagaagaaccgcctcgaggggtacttcaagcagaccaacctgatcggcaacaccaacccgcaccccttcctgaacaagttcaactggaaggcctgccggaacctcgtcgacttctaccagcagtacctggagcagcgcgagaagttcctggaggccatcaagaaccagccctgggagccctaccagtactgcctcctgctgaagatcccgaaggagaaccggaagaacctcgtgaaggggtgggagcagggcgggatcagcctgccccgcggcctgttcacggaggcgatccgggagaccctctccgaggacctgatgctgagcaagcccatccgcaaggagatcaagaagcacggccgggtggggttcatctcccgcgccatcaccctctacttcaaggagaagtaccaggacaagcaccagagcttctacaacctgtcctacaagctggaggccaaggcgcccctcctgaagcgggaggagcactacgagtactggcagcagaacaagccgcagagccccaccgagtcccagcgcctggagctccacacgagcgaccgctggaaggactacctgctgtacaagcggtggcagcacctcgagaagaagctgcgcctgtaccggaaccaggacgtcatgctctggctgatgaccctggagctcaccaagaaccacttcaaggagctgaacctgaactaccaccagctcaagctggagaacctggccgtgaacgtgcaggaggccgacgccaagctcaaccccctgaaccagaccctgcccatggtcctcccggtgaaggtgtaccccgccacggccttcggcgaggtccagtaccacaagacccccatccgcaccgtgtacatccgggaggagcacaccaaggcgctgaagatggggaacttcaaggccctggtgaaggaccgccggctcaacggcctgttctccttcatcaaggaggagaacgacacgcagaagcacccgatcagccagctgcgcctccggcgcgagctggagatctaccagtccctgcgggtcgacgccttcaaggagaccctcagcctggaggagaagctgctcaacaagcacacctccctgagcagcctggagaacgagttccgcgccctcctggaggagtggaagaaggagtacgccgcgtccagcatggtgaccgacgagcacatcgccttcatcgcctccgtccggaacgccttctgccacaaccagtaccccttctacaaggaggccctgcacgcgcccatccccctcttcaccgtggcccagccgacgaccgaggagaaggacgggctgggcatcgccgaggccctgctcaaggtgctgcgcgagtactgcgagatcgtcaagagccagatctga

SEQ ID NO: 11234 - RNA, 3288 nt, synthetic construct
  misc_feature 1..3288: note = Cas13b variant__Riemerella anatipestifer__WP_004919755.1__Cas13b
  source 1..3288: mol_type = other RNA
atggagaagcccctgctcccgaacgtgtacaccctgaagcacaagttcttctggggcgccttcctgaacatcgcccgccacaacgcgttcatcaccatctgccacatcaacgagcagctcgggctgaagacgcccagcaacgacgacaagatcgtggacgtggtgtgcgagacctggaacaacatcctgaacaacgaccacgacctcctgaagaagtcccagctgaccgagctcatcctgaagcacttccccttcctgaccgccatgtgctaccacccgcccaagaaggagggcaagaagaaggggcaccagaaggagcagcagaaggagaaggagagcgaggcccagtcccaggccgaggccctcaaccccagcaagctgatcgaggcgctggagatcctcgtcaaccagctgcactccctgcggaactactacagccactacaagcacaagaagcccgacgccgagaaggacatcttcaagcacctctacaaggccttcgacgcctccctgcgcatggtgaaggaggactacaaggcgcacttcacggtgaacctgacccgggacttcgcccacctcaaccgcaagggcaagaacaagcaggacaaccccgacttcaaccggtaccgcttcgagaaggacgggttcttcaccgagagcggcctgctgttcttcaccaacctcttcctggacaagcgggacgcctactggatgctgaagaaggtctccggcttcaaggccagccacaagcagcgcgagaagatgacgaccgaggtgttctgccggtcccgcatcctcctgccgaagctgcggctcgagagccgctacgaccacaaccagatgctgctggacatgctctccgagctgagccggtgccccaagctgctctacgagaagctgtccgaggagaacaagaagcacttccaggtggaggccgacgggttcctggacgagatcgaggaggagcagaaccccttcaaggacaccctcatccgccaccaggaccggttcccctacttcgcgctgcgctacctggacctcaacgagagcttcaagtccatccggttccaggtcgacctgggcacctaccactactgcatctacgacaagaagatcggggacgagcaggagaagcgccacctgacgcggaccctcctgagcttcggccgcctgcaggacttcaccgagatcaaccggccgcaggagtggaaggccctcaccaaggacctggactacaaggagacgtccaaccagcccttcatcagcaagaccacgccccactaccacatcaccgacaacaagatcgggttccgcctgggcaccagcaaggagctgtacccctccctcgagatcaaggacggcgccaaccgcatcgccaagtacccgtacaacagcgggttcgtggcccacgcgttcatctccgtgcacgagctgctgcccctcatgttctaccagcacctgaccggcaagagcgaggacctgctcaaggagaccgtccggcacatccagcgcatctacaaggacttcgaggaggagcggatcaacaccatcgaggacctggagaaggccaaccaggggcgcctgcccctcggcgccttccccaagcagatgctgggcctgctccagaacaagcagccggacctgtccgagaaggccaagatcaagatcgagaagctgatcgccgagacgaagctcctgagccaccggctgaacaccaagctcaagtccagccccaagctggggaagcgccgggagaagctgatcaagaccggcgtgctcgcggactggctggtgaaggacttcatgcgcttccagcccgtcgcctacgacgcccagaaccagcccatcaagtccagcaaggccaactccaccgagttctggttcatccggcgcgccctggcgctctacgggggcgagaagaaccggctggaggggtacttcaagcagacgaacctgatcggcaacaccaacccgcaccccttcctcaacaagttcaactggaaggcctgccgcaacctggtggacttctaccagcagtacctggagcagcgggagaagttcctcgaggccatcaagaaccagccctgggagccctaccagtactgcctgctgctcaagatcccgaaggagaaccgcaagaacctggtgaagggctgggagcagggcgggatcagcctgccccggggcctcttcaccgaggccatccgcgagaccctgtccgaggacctgatgctcagcaagcccatccggaaggagatcaagaagcacgggcgcgtcgggttcatctcccgggcgatcacgctgtacttcaaggagaagtaccaggacaagcaccagagcttctacaacctgtcctacaagctcgaggccaaggccccgctgctgaagcgcgaggagcactacgagtactggcagcagaacaagccccagagccccaccgagtcccagcgcctcgagctgcacaccagcgaccggtggaaggactacctgctctacaagcgctggcagcacctggagaagaagctgcggctctaccgcaaccaggacgtgatgctgtggctgatgaccctcgagctgacgaagaaccacttcaaggagctgaacctcaactaccaccagctgaagctggagaacctcgccgtgaacgtccaggaggccgacgcgaagctgaaccccctgaaccagaccctcccgatggtgctgcccgtgaaggtctaccccgccaccgccttcggcgaggtgcagtaccacaagacccccatccggaccgtctacatccgcgaggagcacacgaaggccctgaagatgggcaacttcaaggccctcgtgaaggaccggcgcctgaacgggctgttcagcttcatcaaggaggagaacgacacccagaagcacccgatctcccagctccggctgcgccgggagctggagatctaccagagcctccgcgtggacgcgttcaaggagaccctgtccctggaggagaagctcctgaacaagcacaccagcctgtccagcctcgagaacgagttccgggccctgctggaggagtggaagaaggagtacgccgcctccagcatggtcacggacgagcacatcgccttcatcgcgtccgtgcgcaacgccttctgccacaaccagtaccccttctacaaggaggccctccacgcccccatccccctgttcaccgtggcgcagccgaccaccgaggagaaggacggcctggggatcgccgaggccctcctgaaggtcctgcgggagtactgcgagatcgtcaagagccagatctga

SEQ ID NO: 11235 - RNA, 3288 nt, synthetic construct
  misc_feature 1..3288: note = Cas13b variant__Riemerella anatipestifer__WP_064970887.1__Cas13b
  source 1..3288: mol_type = other RNA
atggagaagcccctgccgcccaacgtgtacaccctcaagcacaagttcttctggggcgccttcctgaacatcgcccgccacaacgcgttcatcaccatctgccacatcaacgagcagctggggctcacgaccccgcccaacgacgacaagatcgccgacgtcgtgtgcggcacctggaacaacatcctgaacaacgaccacgacctgctcaagaagtcccagctgaccgagctgatcctcaagcacttccccttcctggccgccatgtgctaccacccgcccaagaaggaggggaagaagaagggctcccagaaggagcagcagaaggagaaggagaacgaggcccagagccaggcggaggccctgaacccctccgagctcatcaaggtgctgaagacgctggtcaagcagctccggaccctgcgcaactactacagccaccactcccacaagaagcccgacgccgagaaggacatcttcaagcacctgtacaaggccttcgacgcgagcctccggatggtgaaggaggactacaaggcccacttcaccgtgaacctgacccaggacttcgcccacctgaaccgcaaggggaagaacaagcaggacaaccccgacttcgaccggtaccgcttcgagaaggacggcttcttcacggagtccggcctcctgttcttcaccaacctgttcctcgacaagcgggacgcctactggatgctgaagaaggtcagcgggttcaaggcctcccacaagcagagcgagaagatgaccaccgaggtgttctgccgctcccggatcctgctccccaagctgcgcctggagagccggtacgaccacaaccagatgctcctggacatgctgtccgagctcagccgctaccccaagctgctgtacgagaagctctccgaggaggacaagaagcggttccaggtggaggcggacggcttcctggacgagatcgaggaggagcagaacccgttcaaggacacgctgatccgccaccaggaccggttcccctacttcgccctccgctacctggacctgaacgagagcttcaagtccatccggttccaggtcgacctcgggacctaccactactgcatctacgacaagaagatcggcgacgagcaggagaagcgccacctgacccggaccctgctcagcttcgggcgcctgcaggacttcacggagatcaaccggccccaggagtggaaggccctgaccaaggacctcgactacaaggagacctccaagcagcccttcatcagcaagaccacgccgcactaccacatcaccgacaacaagatcggcttccgcctgggcaccagcaaggagctgtacccctccctggaggtgaaggacggggccaaccgcatcgcccagtacccctacaacagcgacttcgtggcgcacgccttcatctccgtccacgagctcctgcccctgatgttctaccagcacctcaccggcaagagcgaggacctgctgaaggagacggtgcggcacatccagcgcatctacaaggacttcgaggaggagcggatcaacaccatcgaggacctcgagaaggccaaccaggggcgcctgccgctgggcgccttccccaagcagatgctcggcctgctgcagaacaagcagcccgacctctccgagaaggccaagatcaagatcgagaagctgatcgcggagaccaagctgctcagccaccggctgaacaccaagctgaagtccagccccaagctcgggaagcgccgggagaagctgatcaagacgggcgtgctggccgactggctcgtcaaggacttcatgcgcttccagccggtggcctacgacgcccagaaccagcccatcgagtccagcaaggccaactccaccgagttccagctgatccagcgggcgctggccctctacgggggcgagaagaaccgcctggaggggtacttcaagcagaccaacctgatcggcaacaccaacccccaccccttcctcaacaagttcaactggaaggcctgccggaacctggtggacttctaccagcagtacctggagcagcgcgagaagttcctcgaggccatcaagaaccagccgtgggagccctaccagtactgcctgctgctcaagatccccaaggagaaccggaagaacctggtcaagggctgggagcagggcgggatcagcctgccgcgcggcctcttcacggaggcgatccgggagaccctgtccaaggacctgaccctcagcaagcccatccgcaaggagatcaagaagcacgggcgggtggggttcatctcccgcgccatcaccctgtacttccgggagaagtaccaggacgaccaccagagcttctacgacctgccctacaagctcgaggccaaggccagccccctgccgaagaaggagcactacgagtactggcagcagaacaagccccagagccccacggagctgcagcgcctcgagctgcacacctccgaccgctggaaggactacctgctctacaagcggtggcagcacctggagaagaagctgcgcctctaccggaaccaggacgtgatgctgtggctgatgaccctcgagctgaccaagaaccacttcaaggagctgaacctcaactaccaccagctgaagctggagaacctcgccgtcaacgtgcaggaggcggacgccaagctgaaccccctgaaccagaccctcccgatggtgctgcccgtcaaggtgtaccccgccacggccttcggcgaggtccagtaccaggagacccccatccgcaccgtgtacatccgggaggagcagaccaaggccctgaagatgggcaacttcaaggcgctcgtgaaggaccgccggctgaacgggctgttcagcttcatcaaggaggagaacgacacgcagaagcacccgatcagccagctccgcctgcggcgcgagctggagatctaccagtccctccgggtcgacgccttcaaggagaccctgaacctggaggagaagctcctgaagaagcacaccagcctgtccagcgtggagaacaagttccgcatcctcctggaggagtggaagaaggagtacgccgcctccagcatggtgaccgacgagcacatcgccttcatcgcgtccgtccggaacgccttctgccacaaccagtaccccttctacgaggaggccctgcacgcccccatccccctcttcacggtggcgcagcagaccaccgaggagaaggacggcctggggatcgccgaggccctgctccgcgtgctgcgggagtactgcgagatcgtcaagagccagatctga

SEQ ID NO: 11236 - RNA, 2853 nt, synthetic construct
  misc_feature 1..2853: note = Cas13b variant__Riemerella anatipestifer__WP_061710138.1__Cas13b
  source 1..2853: mol_type = other RNA
atgttcttcagcttccacaacgcccagcgcgtgatcttcaagcacctgtacaaggccttcgacgcgtccctccggatggtgaaggaggactacaaggcccacttcaccgtgaacctgacccgcgacttcgcccacctgaaccggaagggcaagaacaagcaggacaaccccgacttcaaccgctaccggttcgagaaggacgggttcttcacggagagcggcctcctgttcttcaccaacctgttcctcgacaagcgcgacgcctactggatgctgaagaaggtgtccgggttcaaggccagccacaagcagtccgagaagatgaccaccgaggtcttctgccggagccgcatcctgctcccgaagctgcggctggagtcccgctacgaccacaaccagatgctcctggacatgctgagcgagctctcccggtgccccaagctgctgtacgagaagctcagcgagaaggacaagaagtgcttccaggtggaggcggacggcttcctggacgagatcgaggaggagcagaaccccttcaaggacacgctgatccgccaccaggaccggttcccctacttcgccctccgctacctggacctgaacgagtccttcaagagcatccggttccaggtggacctcgggacctaccactactgcatctacgacaagaagatcggctacgagcaggagaagcgccacctgacccggaccctgctcaacttcggccgcctgcaggacttcacggagatcaaccggccgcaggagtggaaggccctgaccaaggacctcgactacaacgagacctccaaccagcccttcatcagcaagaccacgccccactaccacatcaccgacaacaagatcgggttccgcctgcggacctccaaggagctgtaccccagcctcgaggtcaaggacggcgccaaccgcatcgcgaagtacccgtacaactccgacttcgtggcccacgccttcatcagcatctccgtgcacgagctgctgcccctcatgttctaccagcacctgaccggcaagagcgaggacctgctcaaggagacggtccgccacatccagcggatctacaaggacttcgaggaggagcgcatcaacaccatcgaggacctggagaaggccaaccaggggcggctgcccctcggggccttccccaagcagatgctgggcctgctccagaacaagcagccggacctgagcgagaaggcgaagatcaagatcgagaagctgatcgccgagaccaagctcctgtcccaccgcctgaacaccaagctcaagagctcccccaagctgggcaagcggcgcgagaagctgatcaagacgggggtgctggccgactggctcgtgaaggacttcatgcggttccagcccgtcgtgtacgacgcccagaaccagcccatcaagagctccaaggccaacagcaccgagtcccgcctgatccggcgcgcgctggccctctacggcggggagaagaaccggctggagggctacttcaagcagaccaacctgatcggcaacaccaacccgcaccccttcctcaacaagttcaactggaaggcctgccgcaacctggtggacttctaccagcagtacctggagcagcgggagaagttcctcgaggccatcaagcaccagccctgggagccctaccagtactgcctgctgctcaaggtcccgaaggagaaccgcaagaacctggtgaaggggtgggagcagggcgggatcagcctgccccggggcctcttcacggaggccatccgcgagaccctgtccaaggacctgaccctcagcaagcccatccggaaggagatcaagaagcacgggcgcgtgggcttcatctcccgggcgatcaccctgtacttcaaggagaagtaccaggacaagcaccagagcttctacaacctgtcctacaagctcgaggccaaggcgcccctgctgaagaaggaggagcactacgagtactggcagcagaacaagccgcagagccccacggagtcccagcgcctcgagctgcacaccagcgaccgctggaaggactacctgctctacaagcggtggcagcacctggagaagaagctgcgcctctaccggaaccaggacatcatgctgtggctgatgaccctcgagctgaccaagaaccacttcaaggagctgaacctcaactaccaccagctgaagctggagaacctcgccgtcaacgtgcaggaggccgacgccaagctgaaccccctgaaccagacgctccccatggtgctgccggtcaaggtgtaccccaccaccgccttcggcgaggtgcagtaccacgagacccccatccgcacggtctacatccgggaggagcagaccaaggccctgaagatggggaacttcaaggccctcgtgaaggaccgccacctgaacggcctgttctccttcatcaaggaggagaacgacacccagaagcacccgatcagccagctccggctgcgccgggagctggagatctaccagtccctccgcgtcgacgcgttcaaggagaccctgagcctggaggagaagctcctgaacaagcacgccagcctgtccagcctcgagaacgagttccggaccctgctggaggagtggaagaagaagtacgccgcctccagcatggtgacggacaagcacatcgccttcatcgcgtccgtgcgcaacgccttctgccacaaccagtaccccttctacaaggagaccctccacgcccccatcctgctgttcaccgtcgcccagcccaccacggaggagaaggacgggctcggcatcgccgaggcgctgctgcgggtgctccgcgagtactgcgagatcgtcaagagccagatctga

SEQ ID NO: 11237 - RNA, 2850 nt, synthetic construct
  misc_feature 1..2850: note = ARMAN Cas9 variant__Candidatus Micrarchaeum acidiphilum__OJI07263.1__Cas9
  source 1..2850: mol_type = other RNA
atgcgcgacagcatcaccgcgccccggtactccagcgccctggccgcccgcatcaaggagttcaactccgccttcaagctcggcatcgacctggggaccaagacgggcggggtggccctggtcaaggacaacaaggtgctcctggccaagaccttcctggactaccacaagcagaccctcgaggagcggcgcatccaccggcgcaaccggcgcagccggctggcgcgccggaagcgcatcgcccggctgcgctcctggatcctccggcagaagatctacggcaagcagctgccggacccctacaagatcaagaagatgcagctgcccaacggggtgcgcaagggcgagaactggatcgacctcgtcgtgagcggccgggacctgtcccccgaggccttcgtgcgcgccatcaccctgatcttccagaagcgggggcagcgctacgaggaggtcgcgaaggagatcgaggagatgagctacaaggagttctccacgcacatcaaggccctcaccagcgtgaccgaggaggagttcaccgccctggccgccgagatcgagcggcgccaggacgtggtcgacacggacaaggaggcggagcgctacacccagctgtccgagctcctgagcaaggtgtccgagagcaagtccgagagcaaggaccgggcccagcgcaaggaggacctgggcaaggtggtcaacgccttctgctccgcccaccggatcgaggacaaggacaagtggtgcaaggagctcatgaagctgctggaccgcccggtgcggcacgcccgcttcctcaacaaggtgctgatccggtgcaacatctgcgaccgcgcgacccccaagaagtcccggcccgacgtccgcgagctgctctacttcgacaccgtgcggaacttcctgaaggccgggcgcgtggagcagaaccccgacgtcatcagctactacaagaagatctacatggacgccgaggtgatccgggtgaagatcctgaacaaggagaagctcacggacgaggacaagaagcagaagcgcaagctggccagcgagctgaaccggtacaagaacaaggagtacgtcaccgacgcccagaagaagatgcaggagcagctcaagaccctgctgttcatgaagctcaccggccgcagccggtactgcatggcgcacctgaaggagcgcgccgccgggaaggacgtggaggagggcctgcacggcgtggtccagaagcggcacgaccgcaacatcgcccagcgcaaccacgacctccgggtgatcaacctgatcgagtccctcctgttcgaccagaacaagagcctgtccgacgccatccgcaagaacgggctgatgtacgtcacgatcgaggcgccggagcccaagaccaagcacgccaagaagggcgccgccgtggtgcgggacccccgcaagctcaaggagaagctgttcgacgaccagaacggggtctgcatctacaccggcctgcagctcgacaagctggagatcagcaagtacgagaaggaccacatcttccccgactcccgggacggcccgagcatccgcgacaacctggtgctgaccacgaaggagatcaactccgacaagggggaccggaccccctgggagtggatgcacgacaaccccgagaagtggaaggcgttcgagcgccgggtggccgagttctacaagaagggccgcatcaacgagcggaagcgcgagctcctgctgaacaaggggaccgagtaccccggcgacaacccgaccgagctcgcccgcgggggcgcccgggtcaacaacttcatcacggagttcaacgaccggctgaagacccacggcgtgcaggagctgcagaccatcttcgagcgcaacaagcccatcgtgcaggtcgtgcgcggggaggagacccagcggctccggcgccagtggaacgccctgaaccagaacttcatccccctgaaggaccgggcgatgagcttcaaccacgccgaggacgccgccatcgccgcgtccatgcccccgaagttctggcgcgagcagatctaccgcacggcctggcacttcggccccagcgggaacgagcggcccgacttcgccctcgccgagctggcgccccagtggaacgacttcttcatgaccaagggcgggccgatcatcgccgtgctgggcaagaccaagtactcctggaagcacagcatcatcgacgacaccatctacaagcccttctccaagagcgcctactacgtcggcatctacaagaagcccaacgccatcacgtccaacgccatcaaggtgctccgccccaagctgctgaacggggagcacaccatgagcaagaacgcgaagtactaccaccagaagatcggcaacgagcggttcctcatgaagtcccagaagggcgggagcatcatcaccgtgaagccgcacgacgggcccgagaaggtcctgcagatctcccccacctacgagtgcgccgtgctgacgaagcacgacggcaagatcatcgtgaagttcaagccgatcaagcccctccgcgacatgtacgcccggggcgtcatcaaggccatggacaaggagctggagaccagcctgagctccatgagcaagcacgccaagtacaaggagctccacacccacgacatcatctacctgcccgcgaccaagaagcacgtggacgggtacttcatcatcaccaagctgtccgccaagcacggcatcaaggccctccccgagagcatggtgaaggtcaagtacacgcagatcgggtccgagaacaacagcgaggtgaagctgaccaagccgaagcccgagatcaccctggactccgaggacatcaccaacatctacaacttcacgcgctga

SEQ ID NO: 11238 - RNA, 2904 nt, synthetic construct
  misc_feature 1..2904: note = ARMAN Cas9 variant__Candidatus Parvarchaeum acidiphilum__APG80630.1__Cas9
  source 1..2904: mol_type = other RNA
atgctgggcagctcccgctacctccggtacaacctgaccagcttcgaggggaaggagcccttcctgatcatgggctactacaaggagtacaacaaggagctctccagcaaggcccagaaggagttcaacgaccagatctccgagttcaacagctactacaagctggggatcgacctgggcgacaagaccgggatcgccatcgtgaagggcaacaagatcatcctcgcgaagacgctgatcgacctgcactcccagaagctcgacaagcgccgggaggcccgccggaaccgccggacccgcctgagccggaagaagcgcctggcccggctccgctcctgggtgatgcggcagaaggtgggcaaccagcgcctgccggacccctacaagatcatgcacgacaacaagtactggagcatctacaacaagtccaacagcgccaacaagaagaactggatcgacctgctcatccactccaacagcctgtccgccgacgacttcgtgcgggggctgaccatcatcttccgcaagcggggctacctcgcgttcaagtacctgagccgcctgtccgacaaggagttcgagaagtacatcgacaacctcaagccgcccatcagcaagtacgagtacgacgaggacctggaggagctgtccagccgggtcgagaacggggagatcgaggagaagaagttcgagggcctcaagaacaagctggacaagatcgacaaggagagcaaggacttccaggtgaagcagcgcgaggaggtgaagaaggagctggaggacctcgtcgacctgttcgccaagtccgtggacaacaagatcgacaaggcccggtggaagcgcgagctgaacaacctcctggacaagaaggtgcgcaagatccggttcgacaaccgcttcatcctgaagtgcaagatcaaggggtgcaacaagaacacccccaagaaggagaaggtccgggacttcgagctcaagatggtgctgaacaacgcccgcagcgactaccagatctccgacgaggacctgaacagcttccggaacgaggtgatcaacatcttccagaagaaggagaacctcaagaagggcgagctgaagggcgtcacgatcgaggacctgcgcaagcagctcaacaagaccttcaacaaggcgaagatcaagaaggggatccgggagcagatccgctccatcgtgttcgagaagatcagcggccggtccaagttctgcaaggagcacctgaaggagttcagcgagaagcccgccccctccgaccgcatcaactacggggtgaacagcgcccgggagcagcacgacttccgcgtcctgaacttcatcgacaagaagatcttcaaggacaagctcatcgacccctccaagctgcggtacatcaccatcgagagcccggagcccgagaccgagaagctggagaagggccagatctccgagaagtccttcgagacgctcaaggagaagctggccaaggagaccggcgggatcgacatctacaccggcgagaagctgaagaaggacttcgagatcgagcacatcttcccccgcgcccggatggggcccagcatccgcgagaacgaggtggcgagcaacctcgagaccaacaaggagaaggccgaccggacgccgtgggagtggttcggccaggacgagaagcgctggtccgagttcgagaagcgggtgaacagcctgtactccaagaagaagatcagcgagcgcaagcgcgagatcctgctgaacaagagcaacgagtaccccgggctcaaccccaccgagctgtcccggatccccagcaccctgtccgacttcgtcgagagcatccgcaagatgttcgtgaagtacggctacgaggagccgcagaccctcgtgcagaagggcaagcccatcatccaggtcgtgcgggggcgcgacacgcaggccctgcggtggcgctggcacgccctggactccaacatcatccccgagaaggaccgcaagagctccttcaaccacgccgaggacgcggtgatcgccgcctgcatgcccccgtactacctccggcagaagatcttccgggaggaggccaagatcaagcgcaaggtcagcaacaaggagaaggaggtgacccggcccgacatgcccaccaagaagatcgcccccaactggtccgagttcatgaagacccgcaacgagccggtcatcgaggtgatcggcaaggtgaagcccagctggaagaactccatcatggaccagacgttctacaagtacctgctgaagcccttcaaggacaacctcatcaagatccccaacgtcaagaacacctacaagtggatcggggtgaacggccagaccgacagcctgtccctgccgagcaaggtgctctccatcagcaacaagaaggtcgactccagcaccgtgctgctggtgcacgacaagaagggcgggaagcggaactgggtccccaagagcatcggcgggctcctggtgtacatcacgcccaaggacggcccgaagcgcatcgtgcaggtcaagcccgcgacccaggggctgctcatctaccggaacgaggacggccgcgtggacgccgtgcgggagttcatcaaccccgtcatcgagatgtacaacaacgggaagctggccttcgtggagaaggagaacgaggaggagctgctcaagtacttcaacctgctggagaagggccagaagttcgagcgcatccggcgctacgacatgatcacctacaactccaagttctactacgtgaccaagatcaacaagaaccaccgggtcacgatccaggaggagagcaagatcaaggccgagtccgacaaggtcaagagctccagcggcaaggagtacacccgcaaggagaccgaggagctctccctgcagaagctggccgagctcatcagcatctga

SEQ ID NO: 11239 - RNA, 2850 nt, synthetic construct
  misc_feature 1..2850: note = ARMAN Cas9 variant__Candidatus Micrarchaeum sp.__OJT94500.1__Cas9
  source 1..2850: mol_type = other RNA
atgcgcgacagcatcaccgcgccccggtactccagcgccctggccgcccgcatcaaggagttcaactccgccttcaagctcggcatcgacctggggaccaagacgggcggggtggccctggtcaaggacaacaaggtgctcctggccaagaccttcctggactaccacaagcagaccctcgaggagcggcgcatccaccggcgcaaccggcgcagccggctggcgcgccggaagcgcatcgcccggctgcgctcctggatcctccggcagaagatctacggcaagcagctgccggacccctacaagatcaagaagatgcagctgcccaacggggtgcgcaagggcgagaactggatcgacctcgtcgtgagcggccgggacctgtcccccgaggccttcgtgcgcgccatcaccctgatcttccagaagcgggggcagcgctacgaggaggtcgcgaaggagatcgaggagatgagctacaaggagttctccacgcacatcaaggccctcaccagcgtgaccgaggaggagttcaccgccctggccgccgagatcgagcggcgccaggacgtggtcgacacggacaaggaggcggagcgctacacccagctgtccgagctcctgagcaaggtgtccgagagcaagtccgagagcaaggaccgggcccagcgcaaggaggacctgggcaaggtggtcaacgccttctgctccgcccaccggatcgaggacaaggacaagtggtgcaaggagctcatgaagctgctggaccgcccggtgcggcacgcccgcttcctcaacaaggtgctgatccggtgcaacatctgcgaccgcgcgacccccaagaagtcccggcccgacgtccgcgagctgctctacttcgacaccgtgcggaacttcctgaaggccgggcgcgtggagcagaaccccgacgtcatcagctactacaagaagatctacatggacgccgaggtgatccgggtgaagatcctgaacaaggagaagctcacggacgaggacaagaagcagaagcgcaagctggccagcgagctgaaccggtacaagaacaaggagtacgtcaccgacgcccagaagaagatgcaggagcagctcaagaccctgctgttcatgaagctcaccggccgcagccggtactgcatggcgcacctgaaggagcgcgccgccgggaaggacgtggaggagggcctgcacggcgtggtccagaagcggcacgaccgcaacatcgcccagcgcaaccacgacctccgggtgatcaacctgatcgagtccctcctgttcgacccgaacaagagcctgtccgacgccatccgcaagaacgggctgatgtacgtcacgatcgaggcgcccgagcccaagaccaagcacgccaagaagggcgccgccgtggtgcgggacccccgcaagctcaaggagaagctgttcgacgaccagaacggggtctgcatctacaccggcctgcagctcgacaagctggagatcagcaagtacgagaaggaccacatcttcccggactcccgggacggccccagcatccgcgacaacctggtgctgaccacgaaggagatcaactccgacaagggggaccggaccccctgggagtggatgcacgacaaccccgagaagtggaaggcgttcgagcgccgggtggccgagttctacaagaagggccgcatcaacgagcggaagcgcgagctcctgctgaacaaggggaccgagtacccgggcgacaaccccaccgagctcgcccgcgggggcgcccgggtcaacaacttcatcacggagttcaacgaccggctgaagacccacggcgtgcaggagctgcagaccatcttcgagcgcaacaagcccatcgtgcaggtcgtgcgcggggaggagacccagcggctccggcgccagtggaacgccctgaaccagaacttcatccccctgaaggaccgggcgatgagcttcaaccacgccgaggacgccgccatcgccgcgtccatgccgcccaagttctggcgcgagcagatctaccgcacggcctggcacttcggccccagcgggaacgagcggcccgacttcgccctcgccgagctggccccgcagtggaacgacttcttcatgaccaagggcgggcccatcatcgcggtgctgggcaagaccaagtactcctggaagcacagcatcatcgacgacaccatctacaagcccttctccaagagcgcctactacgtcggcatctacaagaagcccaacgccatcacgtccaacgccatcaaggtgctccgcccgaagctgctgaacggggagcacaccatgagcaagaacgcgaagtactaccaccagaagatcggcaacgagcggttcctcatgaagtcccagaagggcgggagcatcatcaccgtgaagccccacgacgggcccgagaaggtcctgcagatctccccgacctacgagtgcgccgtgctgacgaagcacgacggcaagatcatcgtgaagttcaagcccatcaagcccctccgcgacatgtacgcccggggcgtcatcaaggccatggacaaggagctggagaccagcctgagctccatgagcaagcacgccaagtacaaggagctccacacccacgacatcatctacctgcccgcgaccaagaagcacgtggacgggtacttcatcatcaccaagctgtccgccaagcacggcatcaaggccctcccggagagcatggtgaaggtcaagtacacgcagatcgggtccgagaacaacagcgaggtgaagctgaccaagcccaagcccgagatcaccctggactccgaggacatcaccaacatctacaacttcacgcgctga

SEQ ID NO: 11240 - RNA, 2961 nt, synthetic construct
  misc_feature 1..2961: note = CasX variant__Deltaproteobacteria bacterium__OGP07438.1__CasX
  source 1..2961: mol_type = other RNA
atggagaagcgcatcaacaagatccggaagaagctgagcgccgacaacgccaccaagcccgtgtcccgcagcggcccgatgaagaccctcctggtccgggtgatgacggacgacctgaagaagcgcctcgagaagcggcgcaagaagcccgaggtgatgccccaggtcatctccaacaacgcggccaacaacctgcggatgctgctcgacgactacaccaagatgaaggaggccatcctccaggtgtactggcaggagttcaaggacgaccacgtggggctgatgtgcaagttcgcccagcccgccagcaagaagatcgaccagaacaagctgaagccggagatggacgagaagggcaacctgaccaccgcggggttcgcctgctcccagtgcggccagcccctgttcgtctacaagctcgagcaggtcagcgagaaggggaaggcctacacgaactacttcggccgctgcaacgtggccgagcacgagaagctgatcctgctcgcgcagctgaagcccgagaaggactccgacgaggccgtgacctacagcctgggcaagttcgggcagcgggccctcgacttctactccatccacgtgaccaaggagagcacccaccccgtgaagccgctggcccagatcgccggcaaccgctacgcgtccgggcccgtcggcaaggccctgagcgacgcctgcatggggacgatcgcctccttcctcagcaagtaccaggacatcatcatcgagcaccagaaggtggtgaagggcaaccagaagcggctggagtccctgcgcgagctcgccggcaaggagaacctggagtaccccagcgtcaccctgcccccgcagccccacaccaaggagggggtggacgcgtacaacgaggtgatcgcccgggtccgcatgtgggtgaacctcaacctgtggcagaagctgaagctctcccgggacgacgccaagcccctgctgcgcctcaagggcttccccagcttcccggtggtcgagcggcgcgagaacgaggtggactggtggaacaccatcaacgaggtgaagaagctgatcgacgccaagcgggacatggggcgcgtcttctggtccggcgtgacggccgagaagcggaacaccatcctggagggctacaactacctccccaacgagaacgaccacaagaagcgcgaggggagcctggagaaccccaagaagcccgcgaagcgccagttcggcgacctgctcctgtacctggagaagaagtacgccggggactggggcaaggtcttcgacgaggcctgggagcggatcgacaagaagatcgccgggctcaccagccacatcgagcgcgaggaggcccggaacgcggaggacgcccagtccaaggccgtgctgaccgactggctgcgcgccaaggcgagcttcgtgctcgagcggctgaaggagatggacgagaaggagttctacgcctgcgagatccagctgcagaagtggtacggcgacctccgcggcaacccgttcgccgtcgaggccgagaaccgggtggtggacatctccgggttcagcatcggctccgacgggcacagcatccagtaccgcaacctgctggcctggaagtacctggagaacggcaagcgggagttctacctcctgatgaactacgggaagaagggccgcatccggttcacggacggcaccgacatcaagaagtccgggaagtggcagggcctgctctacgggggcgggaaggcgaaggtcatcgacctgaccttcgaccccgacgacgagcagctgatcatcctccccctggccttcggcacccgccagggccgggagttcatctggaacgacctgctcagcctggagacggggctgatcaagctcgccaacggccgcgtgatcgagaagaccatctacaacaagaagatcgggcgggacgagcccgccctgttcgtggccctgaccttcgagcgccgggaggtcgtggacccgtccaacatcaagcccgtgaacctcatcggcgtcgaccgcggcgagaacatccccgcggtgatcgccctgaccgaccccgaggggtgcccgctgcccgagttcaaggacagctccggcgggcccacggacatcctccggatcggcgaggggtacaaggagaagcagcgcgccatccaggccgccaaggaggtggagcagcgccgggcgggcggctacagccgcaagttcgcctccaagagccggaacctggccgacgacatggtccgcaactccgcccgggacctgttctaccacgcggtgacccacgacgccgtgctcgtcttcgagaacctgagccgcgggttcggccggcaggggaagcgcaccttcatgaccgagcggcagtacacgaagatggaggactggctgaccgccaagctcgcctacgagggcctgacctccaagacctacctgagcaagacgctcgcccagtacacctccaagacctgcagcaactgcgggttcaccatcacgaccgcggactacgacggcatgctggtgcgcctgaagaagaccagcgacggctgggccaccaccctcaacaacaaggagctgaaggccgaggggcagatcacgtactacaaccggtacaagcgccagaccgtggagaaggagctgtccgccgagctcgaccggctgagcgaggagtccggcaacaacgacatcagcaagtggaccaaggggcgccgggacgaggccctgttcctcctgaagaagcgcttctcccaccggccggtccaggagcagttcgtgtgcctggactgcggccacgaggtgcacgcggacgagcaggccgccctcaacatcgcccgcagctggctgttcctgaactccaacagcaccgagttcaagtcctacaagagcgggaagcagcccttcgtcggcgcctggcaggcgttctacaagcggcgcctcaaggaggtgtggaagcccaacgcctga

SEQ ID NO: 11241 - RNA, 2937 nt, synthetic construct
  misc_feature 1..2937: note = CasX variant__Planctomycetes bacterium__OHB99618.1__CasX
  source 1..2937: mol_type = other RNA
atgcaggagatcaagcgcatcaacaagatccggcgccggctggtgaaggacagcaacaccaagaaggccggcaagaccgggcccatgaagacgctcctggtccgcgtgatgaccccggacctgcgggagcgcctcgagaacctgcggaagaagcccgagaacatcccccagcccatctccaacaccagccgcgccaacctgaacaagctcctgaccgactacacggagatgaagaaggcgatcctgcacgtgtactgggaggagttccagaaggacccggtcggcctcatgtcccgggtggcccagcccgcccccaagaacatcgaccagcgcaagctgatccccgtgaaggacgggaacgagcggctgaccagctccggcttcgcctgcagccagtgctgccagccgctctacgtctacaagctggagcaggtcaacgacaaggggaagccccacaccaactacttcggccgctgcaacgtgtccgagcacgagcggctgatcctcctgagcccccacaagcccgaggccaacgacgagctggtgacctactccctcggcaagttcgggcagcgcgcgctggacttctacagcatccacgtgacgcgggagtccaaccacccggtgaagcccctggagcagatcggcgggaacagctgcgcctccggccccgtcgggaaggccctcagcgacgcctgcatgggcgcggtggcctccttcctgaccaagtaccaggacatcatcctggagcaccagaaggtgatcaagaagaacgagaagcgcctcgccaacctgaaggacatcgccagcgccaacggcctggcgttccccaagatcaccctcccgccccagccccacaccaaggaggggatcgaggcctacaacaacgtcgtggcccagatcgtgatctgggtcaacctgaacctgtggcagaagctcaagatcggccgggacgaggccaagcccctgcagcgcctgaaggggttcccgtccttccccctcgtggagcggcaggccaacgaggtggactggtgggacatggtctgcaacgtgaagaagctgatcaacgagaagaaggaggacggcaaggtgttctggcagaacctggcgggctacaagcgccaggaggccctcctgccctacctgagctccgaggaggaccggaagaaggggaagaagttcgcccgctaccagttcggcgacctcctgctgcacctcgagaagaagcacggggaggactggggcaaggtctacgacgaggcctgggagcgcatcgacaagaaggtggaggggctgagcaagcacatcaagctggaggaggagcggcgcagcgaggacgcccagtccaaggcggccctcacggactggctgcgggccaaggccagcttcgtcatcgagggcctgaaggaggccgacaaggacgagttctgccgctgcgagctcaagctgcagaagtggtacggcgacctgcgggggaagcccttcgcgatcgaggccgagaactccatcctggacatcagcggcttctccaagcagtacaactgcgccttcatctggcagaaggacggggtgaagaagctcaacctgtacctgatcatcaactacttcaagggcgggaagctccgcttcaagaagatcaagccggaggccttcgaggcgaaccggttctacaccgtgatcaacaagaagtccggcgagatcgtccccatggaggtgaacttcaacttcgacgaccccaacctgatcatcctgcccctcgccttcggcaagcgccaggggcgggagttcatctggaacgacctgctgagcctcgagaccggcagcctgaagctggccaacgggcgcgtgatcgagaagaccctctacaaccggcgcacgcggcaggacgagccggccctgttcgtcgccctgaccttcgagcgccgggaggtgctcgactccagcaacatcaagcccatgaacctgatcggcatcgaccgcggggagaacatccccgcggtgatcgccctgaccgacccggagggctgccccctctcccggttcaaggacagcctgggcaaccccacccacatcctgcgcatcggggagtcctacaaggagaagcagcggacgatccaggccgccaaggaggtcgagcagcgccgcgccggcgggtacagccggaagtacgcgtccaaggccaagaacctcgccgacgacatggtgcgcaacaccgcccgggacctgctgtactacgccgtgacccaggacgcgatgctcatcttcgagaacctgagccgcggcttcggccggcaggggaagcgcaccttcatggccgagcggcagtacacgcgcatggaggactggctgaccgccaagctcgcctacgagggcctgccctccaagacctacctgagcaagaccctcgcgcagtacacgtccaagacctgcagcaactgcgggttcaccatcaccagcgccgactacgaccgggtcctggagaagctgaagaagacggccaccggctggatgaccaccatcaacgggaaggagctcaaggtggagggccagatcacgtactacaaccgctacaagcggcagaacgtggtcaaggacctgtccgtggagctggaccgcctcagcgaggagtccgtgaacaacgacatcagctcctggaccaagggccggagcggggaggccctgtccctgctcaagaagcgcttcagccaccggccggtccaggagaagttcgtgtgcctgaactgcggcttcgagacccacgccgacgagcaggcggccctgaacatcgcccgctcctggctgttcctccggagccaggagtacaagaagtaccagaccaacaagaccacggggaacaccgacaagcgcgccttcgtggagacctggcagtccttctaccggaagaagctgaaggaggtctggaagcccgccgtgtga

SEQ ID NO: 11242 - RNA, 3378 nt, synthetic construct
  misc_feature 1..3378: note = CasY variant__Candidatus Katanobacteria bacterium__OJI08769.1__CasY
  source 1..3378: mol_type = other RNA
atgcgcaagaagctgttcaagggctacatcctccacaacaagcggctggtgtacaccgggaaggccgccatccgcagcatcaagtaccccctggtcgcgccgaacaagaccgccctcaacaacctgtccgagaagatcatctacgactacgagcacctgttcggccccctcaacgtggccagctacgcccggaactccaaccgctacagcctggtggacttctggatcgactccctgcgggccggggtcatctggcagagcaagtccacgagcctcatcgacctgatctccaagctggagggcagcaagtcccccagcgagaagatcttcgagcagatcgacttcgagctcaagaacaagctggacaaggagcagttcaaggacatcatcctgctcaacaccgggatccgctccagctccaacgtgcggagcctgcgcggccggttcctgaagtgcttcaaggaggagttccgcgacaccgaggaggtgatcgcgtgcgtcgacaagtggtccaaggacctcatcgtggagggcaagagcatcctggtgtccaagcagttcctgtactgggaggaggagttcgggatcaagatcttcccccacttcaaggacaaccacgacctcccgaagctgaccttcttcgtcgagcccagcctggagttcagcccccacctccccctggccaactgcctggagcggctcaagaagttcgacatctcccgcgagagcctgctgggcctcgacaacaacttctccgccttcagcaactacttcaacgagctgttcaacctgctctcccgcggggagatcaagaagatcgtgacggccgtgctggcggtcagcaagtcctgggagaacgagccggagctggagaagcggctccacttcctgagcgagaaggccaagctgctcggctaccccaagctgacctccagctgggccgactaccggatgatcatcgggggcaagatcaagtcctggcacagcaactacaccgagcagctgatcaaggtgcgcgaggacctcaagaagcaccagatcgccctggacaagctgcaggaggacctcaagaaggtggtcgactccagcctgcgggagcagatcgaggcccagcgcgaggcgctgctccccctgctggacaccatgctgaaggagaaggacttctccgacgacctcgagctgtaccggttcatcctgagcgacttcaagtccctcctgaacggcagctaccagcgctacatccagacggaggaggagcggaaggaggaccgcgacgtgaccaagaagtacaaggacctgtactccaacctccgcaacatcccccggttcttcggggagagcaagaaggagcagttcaacaagttcatcaacaagagcctgccgaccatcgacgtgggcctgaagatcctcgaggacatccgcaacgccctggagaccgtctccgtgcggaagccgcccagcatcacggaggagtacgtgaccaagcagctggagaagctctcccgcaagtacaagatcaacgccttcaacagcaaccggttcaagcagatcaccgagcaggtcctgcgcaagtacaacaacggggagctgcccaagatctccgaggtgttctaccggtacccccgcgagagccacgtggccatccggatcctccccgtcaagatctccaacccccgcaaggacatcagctacctgctggacaagtaccagatctcccccgactggaagaacagcaacccgggcgaggtggtcgacctcatcgagatctacaagctgaccctgggctggctcctgtcctgcaacaaggacttcagcatggacttctccagctacgacctgaagctgttccccgaggccgcgtccctcatcaagaacttcgggagctgcctgtccggctactacctcagcaagatgatcttcaactgcatcacgagcgagatcaaggggatgatcaccctgtacacccgggacaagttcgtggtgcgctacgtcacccagatgatcggctccaaccagaagttccccctgctctgcctggtgggggagaagcagacgaagaacttcagccggaactggggcgtgctgatcgaggagaagggcgacctcggggaggagaagaaccaggagaagtgcctgatcttcaaggacaagaccgacttcgccaaggccaaggaggtcgagatcttcaagaacaacatctggcgcatccggacctccaagtaccagatccagttcctgaaccgcctcttcaagaagaccaaggagtgggacctgatgaacctggtgctcagcgagccctccctggtgctggaggaggagtggggcgtcagctgggacaaggacaagctcctgccgctgctcaagaaggagaagtcctgcgaggagcggctgtactacagcctgcccctcaacctggtgcccgccacggactacaaggagcagtccgccgagatcgagcagcgcaacacctacctggggctcgacgtgggcgagttcggggtcgcgtacgccgtggtgcggatcgtccgcgaccgcatcgagctgctgagctggggcttcctcaaggaccccgccctgcggaagatccgcgagcgggtgcaggacatgaagaagaagcaggtcatggccgtgttctccagctccagcaccgccgtggcgcgcgtgcgggagatggccatccactccctgcgcaaccagatccacagcatcgccctcgcctacaaggcgaagatcatctacgagatctccatcagcaacttcgagaccggcgggaaccggatggccaagatctaccgctccatcaaggtcagcgacgtgtaccgggagagcggcgccgacacgctggtgtccgagatgatctgggggaagaagaacaagcagatgggcaaccacatcagctcctacgccaccagctacacgtgctgcaactgcgcccgcaccccgttcgagctggtcatcgacaacgacaaggagtacgagaagggcggggacgagttcatcttcaacgtgggcgacgagaagaaggtgcgggggttcctccagaagtccctgctgggcaagaccatcaaggggaaggaggtcctcaagagcatcaaggagtacgcgcgcccgcccatccgggaggtgctgctggagggcgaggacgtggagcagctcctgaagcgccggggcaactcctacatctaccgctgccccttctgcgggtacaagaccgacgccgacatccaggccgccctgaacatcgcctgccggggctacatcagcgacaacgcgaaggacgccgtcaaggagggggagcgcaagctcgactacatcctggaggtgcggaagctgtgggagaagaacggcgccgtgctccgctccgccaagttcctgtga

SEQ ID NO: 11243 - RNA, 3864 nt, synthetic construct
  misc_feature 1..3864: note = CasY variant__Candidatus Kerfeldbacteria bacterium__OGY82221.1__CasY
  source 1..3864: mol_type = other RNA
atgaagcgcatcctgaacagcctcaaggtggccgccctgcggctcctcttccgcggcaaggggtccgagctggtcaagaccgtgaagtaccccctggtgagcccggtccagggcgcggtggaggagctcgccgaggccatccggcacgacaacctgcacctgttcgggcagaaggagatcgtggacctcatggagaaggacgagggcacccaggtctactccgtggtggacttctggctggacacgctgcgcctcgggatgttcttcagcccctccgccaacgccctgaagatcaccctgggcaagttcaacagcgaccaggtctcccccttccggaaggtgctcgagcagagccccttcttcctggcgggccgcctgaaggtggagccggccgagcggatcctctccgtcgagatccgcaagatcgggaagcgggagaaccgcgtggagaactacgccgccgacgtggagacctgcttcatcggccagctgagctccgacgagaagcagagcatccagaagctggcgaacgacatctgggactccaaggaccacgaggagcagcggatgctcaaggccgacttcttcgccatccccctgatcaaggaccccaaggccgtcaccgaggaggaccccgagaacgagacggccgggaagcagaagccgctggagctctgcgtgtgcctggtgcccgagctgtacacccgcggcttcgggagcatcgcggacttcctcgtccagcggctgaccctgctccgcgacaagatgtccaccgacacggccgaggactgcctggagtacgtgggcatcgaggaggagaagggcaacgggatgaacagcctgctcggcaccttcctgaagaacctgcagggggacggcttcgagcagatcttccagttcatgctcggctcctacgtggggtggcagggcaaggaggacgtcctgcgggagcgcctggacctcctggccgagaaggtgaagcggctgcccaagcccaagttcgccggggagtggagcggccaccgcatgttcctccacgggcagctgaagtcctggagcagcaacttcttccggctgttcaacgagacccgcgagctcctggagtccatcaagagcgacatccagcacgccaccatgctgatctcctacgtggaggagaagggcggctaccacccgcagctcctgagccagtaccggaagctgatggagcagctgcccgcgctccgcacgaaggtcctggaccccgagatcgagatgacccacatgtccgaggccgtgcgcagctacatcatgatccacaagtccgtcgccgggttcctgcccgacctcctggagagcctggaccgggacaaggaccgcgagttcctcctgtccatcttcccgcggatccccaagatcgacaagaagaccaaggagatcgtggcctgggagctgcccggcgagcccgaggaggggtacctcttcaccgccaacaacctgttccgcaacttcctggagaacccgaagcacgtgccccggttcatggcggagcgcatccccgaggactggacgcggctccgcagcgcccccgtctggttcgacggcatggtgaagcagtggcagaaggtggtcaaccagctggtggagtccccgggggccctgtaccagttcaacgagagcttcctccggcagcgcctgcaggccatgctgaccgtgtacaagcgggacctccagaccgagaagttcctgaagctgctcgccgacgtctgccgccccctggtggacttcttcggcctgggcgggaacgacatcatcttcaagtcctgccaggacccccggaagcagtggcagaccgtgatccccctcagcgtcccggcggacgtgtacacggcctgcgagggcctggccatccgcctgcgggagaccctcgggttcgagtggaagaacctgaagggccacgagcgcgaggacttcctgcggctccaccagctgctggggaacctcctgttctggatccgcgacgccaagctggtggtcaagctcgaggactggatgaacaacccctgcgtgcaggagtacgtggaggcgcggaaggccatcgacctgcccctggagatcttcggcttcgaggtcccgatcttcctcaacggctacctgttctccgagctgcgccagctcgagctgctgctccgccgcaagagcgtgatgacctcctacagcgtgaagaccacggggtcccccaaccggctgttccagctggtctacctccccctgaaccccagcgacccggagaagaagaacagcaacaacttccaggagcggctggacacccccaccggcctctcccgccggttcctggacctgaccctcgacgccttcgccgggaagctgctgacggaccccgtgacccaggagctcaagaccatggccggcttctacgaccacctgttcggcttcaagctgccctgcaagctcgcggccatgagcaaccacccggggtccagctccaagatggtggtcctggccaagcccaagaagggcgtggccagcaacatcgggttcgagcccatccccgacccggcccaccccgtgttccgcgtccggtccagctggcccgagctgaagtacctcgagggcctgctgtacctccccgaggacaccccgctgacgatcgagctggcggagacctccgtgagctgccagtccgtgagctccgtcgccttcgacctcaagaacctgaccaccatcctggggcgcgtgggcgagttccgggtgacggccgaccagcccttcaagctcacccccatcatccccgagaaggaggagagcttcatcggcaagacctacctggggctggacgccggcgagcgctccggggtcggcttcgccatcgtgaccgtggacggggacggctacgaggtccagcggctcggcgtgcacgaggacacccagctgatggcgctgcagcaggtcgccagcaagtccctcaaggagccggtgttccagcccctgcgcaaggggacgttccggcagcaggagcgcatccgcaagagcctgcggggctgctactggaacttctaccacgccctcatgatcaagtaccgggccaaggtggtgcacgaggagagcgtcgggtccagcggcctggtggggcagtggctgcgcgcgttccagaaggacctcaagaaggccgacgtgctgcccaagaagggcggcaagaacggggtcgacaagaagaagcgggagtccagcgcccaggacaccctgtggggcggggccttctccaagaaggaggagcagcagatcgccttcgaggtgcaggcggccggcagctcccagttctgcctcaagtgcgggtggtggttccagctgggcatgcgcgaggtgaaccgggtccaggagagcggcgtggtgctggactggaaccgctccatcgtcaccttcctcatcgagagctccggggagaaggtgtacggcttcagcccccagcagctggagaaggggttccgcccggacatcgagaccttcaagaagatggtccgggacttcatgcgcccgcccatgttcgaccggaagggccgccccgccgccgcctacgagcggttcgtgctgggccgccggcaccgccggtaccgcttcgacaaggtgttcgaggagcggttcgggcgctccgcgctgttcatctgcccccgggtcggctgcgggaacttcgaccacagctccgagcagagcgccgtggtgctggccctgatcggctacatcgccgacaaggaggggatgtccggcaagaagctggtctacgtgcgcctcgccgagctgatggcggagtggaagctgaagaagctcgagcggagccgcgtggaggagcagtccagcgcccagtga

SEQ ID NO: 11244 - RNA, 3579 nt, synthetic construct
  misc_feature 1..3579: note = CasY variant__Candidatus Komeilibacteria bacterium__OJI06454.1__CasY
  source 1..3579: mol_type = other RNA
atggccgagagcaagcagatgcagtgccgcaagtgcggcgcctccatgaagtacgaggtgatcgggctgggcaagaagtcctgccggtacatgtgccccgactgcgggaaccacaccagcgcgcgcaagatccagaacaagaagaagcgggacaagaagtacggcagcgcctccaaggcccagagccagcgcatcgccgtcgccggggcgctctacccggacaagaaggtgcagaccatcaagacgtacaagtaccccgccgacctgaacggcgaggtgcacgaccggggcgtcgccgagaagatcgagcaggccatccaggaggacgagatcgggctgctcggcccctccagcgagtacgcgtgctggatcgcctcccagaagcagagcgagccctactccgtggtggacttctggttcgacgccgtctgcgccgggggcgtgttcgcctacagcggggcgcgcctgctgtccaccgtgctccagctgagcggcgaggagtccgtcctgcgggccgccctcgccagctccccgttcgtggacgacatcaacctggcccaggcggagaagttcctggccgtgagccgccggaccggccaggacaagctcgggaagcgcatcggcgagtgcttcgccgaggggcggctggaggccctgggcatcaaggaccgcatgcgggagttcgtccaggccatcgacgtggcgcagaccgccggccagcgcttcgccgccaagctcaagatcttcgggatctcccagatgcccgaggccaagcagtggaacaacgacagcggcctgacggtgtgcatcctgcccgactactacgtccccgaggagaaccgggcggaccagctcgtggtgctgctgcgccggctccgcgagatcgcctactgcatggggatcgaggacgaggccggcttcgagcacctggggatcgacccgggcgccctgagcaacttctccaacggcaaccccaagcgggggttcctcggccgcctgctgaacaacgacatcatcgcgctcgccaacaacatgagcgccatgaccccctactgggaggggcggaagggcgagctgatcgagcgcctggcctggctcaagcaccgcgccgaggggctgtacctgaaggagccccacttcggcaactcctgggcggaccaccggagccgcatcttctcccggatcgccggctggctcagcgggtgcgccggcaagctgaagatcgccaaggaccagatctccggggtccgcaccgacctgttcctcctgaagcggctgctcgacgccgtgccgcagagcgcgccctcccccgacttcatcgccagcatctccgccctggaccgcttcctggaggccgccgagagctcccaggaccccgcggagcaggtccgggccctctacgccttccacctgaacgccccggcggtgcgcagcatcgccaacaaggccgtgcagcggtccgacagccaggagtggctgatcaaggagctcgacgccgtggaccacctggagttcaacaaggccttccccttcttctccgacaccggcaagaagaagaagaagggggcgaacagcaacggcgccccctccgaggaggagtacacggagaccgagagcatccagcagcccgaggacgccgagcaggaggtcaacggccaggaggggaacggcgccagcaagaaccagaagaagttccagcgcatcccgcggttcttcggggagggctcccgcagcgagtaccggatcctgaccgaggcgccccagtacttcgacatgttctgcaacaacatgcgcgccatcttcatgcagctcgagtcccagccccggaaggcgccccgcgacttcaagtgcttcctgcagaaccggctgcagaagctgtacaagcagaccttcctcaacgcccgcagcaacaagtgccgggccctgctggagtccgtgctcatcagctggggcgagttctacacgtacggggccaacgagaagaagttccgcctgcgccacgaggcctccgagcggagctccgacccggactacgtcgtgcagcaggccctggagatcgcccgccggctgttcctgttcggcttcgagtggcgcgactgcagcgccggggagcgggtggacctggtcgagatccacaagaaggcgatctccttcctcctggccatcacccaggccgaggtgagcgtgggctcctacaactggctggggaacagcaccgtctcccgctacctcagcgtggccggcaccgacacgctgtacggcacccagctggaggagttcctcaacgccaccgtgctgtcccagatgcgggggctggcgatccgcctcagcagccaggagctgaaggacggcttcgacgtccagctggagtccagctgccaggacaacctccagcacctcctggtgtaccgggcctcccgcgacctcgccgcctgcaagcgggccacgtgccccgcggagctggaccccaagatcctggtgctccccgccggggccttcatcgccagcgtcatgaagatgatcgagcgcggcgacgagccgctggccggggcgtacctgcggcaccgcccccactccttcggctggcagatccgggtgcgcggcgtggccgaggtcgggatggaccagggcacggccctcgccttccagaagcccaccgagagcgagccgttcaagatcaagcccttctccgcccagtacgggcccgtgctgtggctgaacagctccagctactcccagagccagtacctcgacggcttcctgtcccagcccaagaactggagcatgcgggtgctgccgcaggcggggtccgtccgcgtggagcagcgggtggccctcatctggaacctgcaggccggcaagatgcgcctggagcggagcggcgcccgcgcgttcttcatgcccgtccccttctccttccgccccagcgggtccggcgacgaggccgtgctcgccccgaaccggtacctggggctgttcccccacagcggcgggatcgagtacgccgtggtcgacgtgctcgacagcgccggcttcaagatcctggagcgcggcaccatcgcggtgaacgggttctcccagaagcggggcgagcgccaggaggaggcccaccgggagaagcagcgccgggggatcagcgacatcggccgcaagaagcccgtccaggccgaggtggacgccgccaacgagctgcaccggaagtacaccgacgtggcgacgcgcctcggctgccggatcgtcgtgcagtgggcgccccagccgaagcccgggaccgcccccaccgcccagaccgtgtacgcccgcgccgtccggacggaggcgccccgctccggcaaccaggaggaccacgcccggatgaagtccagctgggggtacacctggagcacctactgggagaagcgcaagccggaggacatcctgggcatctccacccaggtgtactggaccgggggcatcggcgagagctgccccgccgtggccgtcgccctgctcgggcacatccgggccacctccacccagaccgagtgggagaaggaggaggtggtgttcggccgcctgaagaagttcttccccagctga

SEQ ID NO: 11245 - RNA, 3633 nt, synthetic construct
  misc_feature 1..3633: note = CasY variant__Candidatus Parcubacteria bacterium__APG80656.1__CasY
  source 1..3633: mol_type = other RNA
atgagcaagcgccacccccggatctccggcgtgaaggggtaccgcctgcacgcccagcggctcgagtacaccggcaagagcggggccatgcgcaccatcaagtacccgctgtactccagcccctccggcgggcggacggtcccccgcgagatcgtgagcgcgatcaacgacgactacgtgggcctgtacggcctctccaacttcgacgacctgtacaacgccgagaagcggaacgaggagaaggtctacagcgtgctggacttctggtacgactgcgtgcagtacggggccgtcttctcctacaccgcccccggcctcctgaagaacgtggccgaggtgcgcgggggcagctacgagctgaccaagaccctcaaggggtcccacctgtacgacgagctgcagatcgacaaggtcatcaagttcctcaacaagaaggagatcagccgggcgaacggctccctggacaagctgaagaaggacatcatcgactgcttcaaggccgagtaccgcgagcggcacaaggaccagtgcaacaagctcgccgacgacatcaagaacgccaagaaggacgcgggcgccagcctgggggagcgccagaagaagctgttccgggacttcttcggcatctccgagcagagcgagaacgacaagccgtccttcacgaaccccctcaacctgacctgctgcctgctccccttcgacaccgtgaacaacaaccgcaaccgcggggaggtgctgttcaacaagctgaaggagtacgcccagaagctcgacaagaacgagggcagcctggagatgtgggagtacatcggcatcgggaactccggcaccgccttcagcaacttcctgggggagggcttcctcgggcggctgcgggagaacaagatcacggagctgaagaaggccatgatggacatcaccgacgcgtggcgcggccaggagcaggaggaggagctcgagaagcggctgcgcatcctggccgccctcaccatcaagctgcgggagcccaagttcgacaaccactggggcgggtaccgcagcgacatcaacggcaagctgtccagctggctccagaactacatcaaccagaccgtcaagatcaaggaggacctgaaggggcacaagaaggacctgaagaaggccaaggagatgatcaaccgcttcggcgagtccgacacgaaggaggaggccgtggtgagctccctcctggagagcatcgagaagatcgtcccggacgactccgcggacgacgagaagcccgacatccccgccatcgccatctaccggcgcttcctgagcgacgggcggctcaccctgaaccgcttcgtgcagcgggaggacgtgcaggaggccctgatcaaggagcgcctcgaggccgagaagaagaagaagcccaagaagcggaagaagaagtccgacgcggaggacgagaaggagaccatcgacttcaaggagctgttcccgcacctggccaagcccctcaagctggtccccaacttctacggcgacagcaagcgcgagctgtacaagaagtacaagaacgccgccatctacaccgacgccctgtggaaggcggtggagaagatctacaagtccgccttcagctccagcctcaagaactccttcttcgacacggacttcgacaaggacttcttcatcaagcggctgcagaagatcttcagcgtgtaccgccggttcaacaccgacaagtggaagcccatcgtcaagaactccttcgccccgtactgcgacatcgtgagcctggccgagaacgaggtgctctacaagcccaagcagtcccgcagccgcaagagcgcggccatcgacaagaaccgggtccggctgccctccaccgagaacatcgccaaggccggcatcgccctggcgcgcgagctcagcgtggccgggttcgactggaaggacctgctgaagaaggaggagcacgaggagtacatcgacctcatcgagctgcacaagaccgccctggccctcctgctggccgtcacggagacccagctcgacatctccgcgctggacttcgtggagaacggcaccgtgaaggacttcatgaagacccgggacgggaacctggtcctcgagggccgcttcctggagatgttcagccagtccatcgtgttcagcgagctgcgggggctcgccggcctgatgtcccgcaaggagttcatcacgcgcagcgccatccagaccatgaacggcaagcaggccgagctgctctacatcccccacgagttccagtccgccaagatcaccaccccgaaggagatgagccgggcgttcctggacctggcccccgccgagttcgccacgtccctcgagcccgagagcctgtccgagaagtccctgctcaagctgaagcagatgcgctactacccccactacttcgggtacgagctgacccggaccggccaggggatcgacggcggcgtggcggagaacgccctccgcctggagaagtccccggtcaagaagcgggagatcaagtgcaagcagtacaagaccctggggcgcggccagaacaagatcgtgctctacgtgcggagcagctactaccagacgcagttcctggagtggttcctgcaccgccccaagaacgtccagaccgacgtggccgtgagcgggagcttcctcatcgacgagaagaaggtcaagacccggtggaactacgacgccctgaccgtggccctggagcccgtgtccggcagcgagcgcgtcttcgtgtcccagcccttcacgatcttcccggagaagtccgcggaggaggaggggcagcggtacctcggcatcgacatcggcgagtacgggatcgcctacaccgccctggagatcaccggcgacagcgccaagatcctggaccagaacttcatcagcgacccccagctcaagaccctgcgcgaggaggtgaaggggctgaagctcgaccagcggcgcggcaccttcgccatgccctccacgaagatcgcgcggatccgcgagagcctggtccactccctgcggaaccgcatccaccacctcgccctgaagcacaaggccaagatcgtgtacgagctggaggtgagccggttcgaggaggggaagcagaagatcaagaaggtctacgccaccctcaagaaggccgacgtgtactccgagatcgacgcggacaagaacctgcagaccaccgtgtggggcaagctggccgtcgccagcgagatctccgccagctacacgtcccagttctgcggcgcgtgcaagaagctctggcgcgccgagatgcaggtcgacgagaccatcaccacccaggagctgatcgggacggtgcgggtgatcaagggcgggaccctgatcgacgccatcaaggacttcatgcgcccgcccatcttcgacgagaacgacacccccttccccaagtaccgcgacttctgcgacaagcaccacatcagcaagaagatgcggggcaactcctgcctcttcatctgcccgttctgccgcgccaacgccgacgcggacatccaggccagccagaccatcgccctgctgcggtacgtgaaggaggagaagaaggtggaggactacttcgagcgcttccggaagctcaagaacatcaaggtcctggggcagatgaagaagatctga

SEQ ID NO: 11246 - RNA, 3681 nt, synthetic construct
  misc_feature 1..3681: note = CasY variant__Candidatus Vogelbacteria bacterium__OJI07455.1__CasY
  source 1..3681: mol_type = other RNA
atgcagaaggtgcgcaagaccctgagcgaggtccacaagaacccctacggcaccaaggtgcggaacgccaagacggggtactccctccagatcgagcgcctgagctacaccggcaaggaggggatgcggtccttcaagatcccgctggagaacaagaacaaggaggtgttcgacgagttcgtcaagaagatccgcaacgactacatcagccaggtgggcctcctgaacctgtccgactggtacgagcactaccaggagaagcaggagcactacagcctcgccgacttctggctggactccctgcgggcgggggtgatcttcgcccacaaggagaccgagatcaagaacctcatcagcaagatccgcggcgacaagtccatcgtcgacaagttcaacgccagcatcaagaagaagcacgccgacctgtacgccctggtggacatcaaggcgctctacgacttcctgacctccgacgcccggcgcggcctgaagacggaggaggagttcttcaacagcaagcggaacaccctcttccccaagttccgcaagaaggacaacaaggccgtggacctgtgggtcaagaagttcatcgggctggacaacaaggacaagctcaacttcaccaagaagttcatcggcttcgaccccaacccccagatcaagtacgaccacaccttcttcttccaccaggacatcaacttcgacctggagcggatcacgaccccgaaggagctgatctccacctacaagaagttcctcgggaagaacaaggacctgtacggcagcgacgagaccacggaggaccagctgaagatggtgctcgggttccacaacaaccacggcgccttctccaagtacttcaacgcgagcctggaggccttccgcggccgggacaactccctggtggagcagatcatcaacaacagcccctactggaactcccaccgcaaggagctcgagaagcggatcatcttcctgcaggtccagagcaagaagatcaaggagaccgagctggggaagccccacgagtacctcgccagcttcggcgggaagttcgagtcctgggtgagcaactacctgcgccaggaggaggaggtgaagcggcagctgttcggctacgaggagaacaagaagggccagaagaagttcatcgtcgggaacaagcaggagctcgacaagatcatccgcggcaccgacgagtacgagatcaaggccatctccaaggagaccatcgggctgacgcagaagtgcctgaagctcctggagcagctgaaggacagcgtggacgactacaccctctccctgtaccggcagctgatcgtggagctccgcatccggctgaacgtcgagttccaggagacctaccccgagctgatcggcaagagcgagaaggacaaggagaaggacgccaagaacaagcgcgcggacaagcgctacccgcagatcttcaaggacatcaagctcatccccaacttcctgggggagaccaagcagatggtgtacaagaagttcatccggtccgccgacatcctgtacgagggcatcaacttcatcgaccagatcgacaagcagatcacgcagaacctcctgccctgcttcaagaacgacaaggagcgcatcgagttcaccgagaagcagttcgagaccctgcggcgcaagtactacctgatgaacagctcccggttccaccacgtgatcgagggcatcatcaacaaccgcaagctcatcgagatgaagaagcgggagaacagcgagctgaagaccttctccgacagcaagttcgtcctgtccaagctgttcctgaagaaggggaagaagtacgagaacgaggtgtactacacgttctacatcaaccccaaggcccgcgaccagcggcgcatcaagatcgtgctggacatcaacggcaacaacagcgtcgggatcctccaggacctggtgcagaagctgaagccgaagtgggacgacatcatcaagaagaacgacatgggcgagctcatcgacgccatcgagatcgagaaggtccggctggggatcctgatcgccctctactgcgagcacaagttcaagatcaagaaggagctgctgtccctcgacctgttcgcgagcgcctaccagtacctggagctcgaggacgaccccgaggagctgtccggcaccaacctgggccgcttcctccagagcctggtgtgctccgagatcaagggggccatcaacaagatcagccggaccgagtacatcgagcgctacaccgtgcagcccatgaacacggagaagaactaccccctgctcatcaacaaggagggcaaggccacctggcacatcgccgcgaaggacgacctgagcaagaagaagggcggcgggaccgtcgccatgaaccagaagatcgggaagaacttcttcggcaagcaggactacaagaccgtgttcatgctgcaggacaagcggttcgacctcctgacgtccaagtaccacctccagttcctcagcaagaccctggacaccgggggcgggtcctggtggaagaacaagaacatcgacctgaacctcagctcctacagcttcatcttcgagcagaaggtgaaggtcgagtgggacctgaccaacctggaccacccgatcaagatcaagccctccgagaacagcgacgaccgccgcctcttcgtgtccatccccttcgtgatcaagcccaagcagacgaagcggaaggacctgcagacccgggtcaactacatgggcatcgacatcggcgagtacgggctggcctggaccatcatcaacatcgacctcaagaacaagaagatcaacaagatcagcaagcagggcttcatctacgagccgctgacccacaaggtgcgcgactacgtggccaccatcaaggacaaccaggtccgcgggacgttcggcatgcccgacaccaagctggcccggctccgcgagaacgcgatcacctccctgcggaaccaggtgcacgacatcgccatgcgctacgacgccaagcccgtgtacgagttcgagatcagcaacttcgagaccgggtccaacaaggtcaaggtgatctacgacagcgtgaagcgggccgacatcggccgcggccagaacaacacggaggcggacaacaccgaggtcaacctggtgtgggggaagacctccaagcagttcggcagccagatcggggcctacgccacctcctacatctgcagcttctgcggctacagcccctactacgagttcgagaactccaagagcggggacgaggagggcgcccgggacaacctctaccagatgaagaagctgtcccgcccgagcctggaggacttcctccagggcaaccccgtgtacaagacgttccgggacttcgacaagtacaagaacgaccagcgcctgcagaagaccggggacaaggacggcgagtggaagacccaccgggggaacaccgccatctacgcgtgccagaagtgccgccacatctccgacgccgacatccaggccagctactggatcgccctgaagcaggtcgtgcgggacttctacaaggacaaggagatggacggcgacctcatccagggggacaacaaggacaagcgcaaggtgaacgagctgaaccggctgatcggcgtccacaaggacgtgcccatcatcaacaagaacctcatcacgtccctggacatcaacctgctctga

SEQ ID NO: 11247 - RNA, 3603 nt, synthetic construct
  misc_feature 1..3603: note = CasY variant__Candidatus Vogelbacteria bacterium__OJI09436.1__CasY
  source 1..3603: mol_type = other RNA
atgaaggccaagaagtccttctacaaccagaagcgcaagttcggcaagcgggggtaccgcctgcacgacgagcggatcgcctacagcggcgggatcggcagcatgcgctccatcaagtacgagctcaaggacagctacgggatcgcgggcctgcggaaccgcatcgccgacgccaccatctccgacaacaagtggctgtacggcaacatcaacctcaacgactacctggagtggcggagctccaagaccgacaagcagatcgaggacggggaccgcgagagctccctgctcggcttctggctggaggccctgcggctcgggttcgtgttcagcaagcagtcccacgcccccaacgacttcaacgagacggcgctgcaggacctgttcgagaccctcgacgacgacctgaagcacgtcctggaccgcaagaagtggtgcgacttcatcaagatcggcaccccgaagaccaacgaccaggggcggctcaagaagcagatcaagaacctgctgaagggcaacaagcgcgaggagatcgagaagacgctcaacgagagcgacgacgagctgaaggagaagatcaaccggatcgccgacgtgttcgccaagaacaagtccgacaagtacaccatcttcaagctggacaagcccaacaccgagaagtacccccgcatcaacgacgtgcaggtcgccttcttctgccaccccgacttcgaggagatcaccgagcgggaccgcacgaagaccctcgacctgatcatcaaccggttcaacaagcgctacgagatcaccgagaacaagaaggacgacaagaccagcaaccggatggcgctgtactccctcaaccagggctacatcccgcgcgtgctgaacgacctgttcctcttcgtgaaggacaacgaggacgacttcagccagttcctgtccgacctggagaacttcttcagcttctccaacgagcagatcaagatcatcaaggagcggctcaagaagctgaagaagtacgccgagcccatccccgggaagccccagctggccgacaagtgggacgactacgccagcgacttcggcgggaagctcgagagctggtactccaaccgcatcgagaagctgaagaagatcccggagagcgtctccgacctgcgcaacaacctcgagaagatccggaacgtgctgaagaagcagaacaacgccagcaagatcctggagctctcccagaagatcatcgagtacatccgcgactacggcgtgagcttcgagaagcccgagatcatcaagttctcctggatcaacaagacgaaggacggccagaagaaggtcttctacgtggcgaagatggccgaccgggagttcatcgagaagctggacctgtggatggccgacctccgcagccagctgaacgagtacaaccaggacaacaaggtgtccttcaagaagaaggggaagaagatcgaggagctgggcgtcctcgacttcgccctgaacaaggccaagaagaacaagagcaccaagaacgagaacgggtggcagcagaagctgtccgagagcatccagtccgcgcccctcttcttcggcgaggggaaccgggtgcgcaacgaggaggtgtacaacctgaaggacctgctgttcagcgagatcaagaacgtcgagaacatcctcatgtccagcgaggccgaggacctgaagaacatcaagatcgagtacaaggaggacggcgccaagaagggcaactacgtgctgaacgtgctcgcccggttctacgcccgcttcaacgaggacgggtacggcgggtggaacaaggtcaagaccgtgctggagaacatcgcgcgggaggccggcaccgacttctccaagtacgggaacaacaacaaccgcaacgccggccggttctacctgaacggccgcgagcgccaggtgttcacgctcatcaagttcgagaagtccatcaccgtcgagaagatcctggagctggtgaagctccccagcctgctggacgaggcctaccgggacctcgtgaacgagaacaagaaccacaagctgcgggacgtcatccagctgagcaagaccatcatggccctcgtgctgagccactccgacaaggagaagcagatcgggggcaactacatccacagcaagctgtccgggtacaacgcgctcatcagcaagcgcgacttcatctcccggtacagcgtccagaccacgaacggcacccagtgcaagctggccatcgggaagggcaagtccaagaagggcaacgagatcgaccgctacttctacgccttccagttcttcaagaacgacgacagcaagatcaacctgaaggtgatcaagaacaactcccacaagaacatcgacttcaacgacaacgagaacaagatcaacgccctccaggtgtacagctccaactaccagatccagttcctggactggttcttcgagaagcaccaggggaagaagaccagcctggaggtcggcgggtccttcaccatcgcggagaagtccctcacgatcgactggagcggcagcaacccgcgggtgggcttcaagcgctccgacaccgaggagaagcgcgtgttcgtcagccagcccttcaccctgatccccgacgacgaggacaaggagcggcgcaaggagcggatgatcaagaccaagaaccgcttcatcgggatcgacatcggcgagtacgggctggcctggagcctcatcgaggtggacaacggcgacaagaacaaccgggggatccgccagctggagtccggcttcatcacggacaaccagcagcaggtcctgaagaagaacgtcaagagctggcggcagaaccagatccgccagaccttcacctcccccgacaccaagatcgcccggctccgcgagagcctgatcggctcctacaagaaccagctggagagcctcatggtggccaagaaggccaacctgtccttcgagtacgaggtgagcgggttcgaggtgggcgggaagcgggtggcgaagatctacgactccatcaagcgcggcagcgtgcggaagaaggacaacaactcccagaacgaccagagctgggggaagaagggcatcaacgagtggtccttcgagacgaccgccgccggcaccagccagttctgcacccactgcaagcgctggtccagcctggccatcgtcgacatcgaggagtacgagctcaaggactacaacgacaacctgttcaaggtgaagatcaacgacggggaggtgcggctgctcggcaagaaggggtggcgctccggcgagaagatcaaggggaaggagctgttcggcccggtcaaggacgccatgcggcccaacgtggacggcctggggatgaagatcgtgaagcgcaagtacctcaagctggacctgcgggactgggtcagccgctacggcaacatggcgatcttcatctgcccctacgtggactgccaccacatctcccacgccgacaagcaggccgccttcaacatcgccgtgcgggggtacctcaagagcgtcaaccccgaccgcgcgatcaagcacggcgacaaggggctgagccgcgacttcctgtgccaggaggagggcaagctcaacttcgagcagatcggcctgctgtga

SEQ ID NO: 11248 - RNA, 3462 nt, synthetic construct
  misc_feature 1..3462: note = CasY variant__Candidatus Vogelbacteria bacterium__PIP58309.1__CasY
  source 1..3462: mol_type = other RNA
atgcagaaggtgcgcaagaccctgagcgaggtccacaagaacccctacggcaccaaggtgcggaacgccaagacggggtactccctccagatcgagcgcctgagctacaccggcaaggaggggatgcggtccttcaagatcccgctggagaacaagaacaaggaggtgttcgacgagttcgtcaagaagatccgcaacgactacatcagccaggtgggcctcctgaacctgtccgactggtacgagcactaccaggagaagcaggagcactacagcctcgccgacttctggctggactccctgcgggcgggggtgatcttcgcccacaaggagaccgagatcaagaacctcatcagcaagatccgcggcgacaagtccatcgtcgacaagttcaacgccagcatcaagaagaagcacgccgacctgtacgccctggtggacatcaaggcgctctacgacttcctgacctccgacgcccggcgcggcctgaagacggaggaggagttcttcaacagcaagcggaacaccctcttccccaagttccgcaagaaggacaacaaggccgtggacctgtgggtcaagaagttcatcgggctggacaacaaggacaagctcaacttcaccaagaagttcatcggcttcgaccccaacccccagatcaagtacgaccacaccttcttcttccaccaggacatcaacttcgacctggagcggatcacgaccccgaaggagctgatctccacctacaagaagttcctcgggaagaacaaggacctgtacggcagcgacgagaccacggaggaccagctgaagatggtgctcgggttccacaacaaccacggcgccttctccaagtacttcaacgcgagcctggaggccttccgcggccgggacaactccctggtggagcagatcatcaacaacagcccctactggaactcccaccgcaaggagctcgagaagcggatcatcttcctgcaggtccagagcaagaagatcaaggagaccgagctggggaagccccacgagtacctcgccagcttcggcgggaagttcgagtcctgggtgagcaactacctgcgccaggaggaggaggtgaagcggcagctgttcggctacgaggagaacaagaagggccagaagaagttcatcgtcgggaacaagcaggagctcgacaagatcatccgcggcaccgacgagtacgagatcaaggccatctccaaggagaccatcgggctgacgcagaagtgcctgaagctcctggagcagctgaaggacagcgtggacgactacaccctctccctgtaccggcagctgatcgtggagctccgcatccggctgaacgtcgagttccaggagacctaccccgagctgatcggcaagagcgagaaggacaaggagaaggacgccaagaacaagcgcgcggacaagcgctacccgcagatcttcaaggacatcaagctcatccccaacttcctgggggagaccaagcagatggtgtacaagaagttcatccggtccgccgacatcctgtacgagggcatcaacttcatcgaccagatcgacaagcagatcacgcagaacctcctgccctgcttcaagaacgacaaggagcgcatcgagttcaccgagaagcagttcgagaccctgcggcgcaagtactacctgatgaacagctcccggttccaccacgtgatcgagggcatcatcaacaaccgcaagctcatcgagatgaagaagcgggagaacagcgagctgaagaccttctccgacagcaagttcgtcctgtccaagctgttcctgaagaaggggaagaagtacgagaacgaggtgtactacacgttctacatcaaccccaaggcccgcgaccagcggcgcatcaagatcgtgctggacatcaacggcaacaacagcgtcgggatcctccaggacctggtgcagaagctgaagccgaagtgggacgacatcatcaagaagaacgacatgggcgagctcatcgacgccatcgagatcgagaaggtccggctggggatcctgatcgccctctactgcgagcacaagttcaagatcaagaaggagctgctgtccctcgacctgttcgcgagcgcctaccagtacctggagctcgaggacgaccccgaggagctgtccggcaccaacctgggccgcttcctccagagcctggtgtgctccgagatcaagggggccatcaacaagatcagccggaccgagtacatcgagcgctacaccgtgcagcccatgaacacggagaagaactaccccctgctcatcaacaaggagggcaaggccacctggcacatcgccgcgaaggacgacctgagcaagaagaagggcggcgggaccgtcgccatgaaccagaagatcgggaagaacttcttcggcaagcaggactacaagaccgtgttcatgctgcaggacaagcggttcgacctcctgacgtccaagtaccacctccagttcctcagcaagaccctggacaccgggggcgggtcctggtggaagaacaagaacatcgacctgaacctcagctcctacagcttcatcttcgagcagaaggtgaaggtcgagtgggacctgaccaacctggaccacccgatcaagatcaagccctccgagaacagcgacgaccgccgcctcttcgtgtccatccccttcgtgatcaagcccaagcagacgaagcggaaggacctgcagacccgggtcaactacatgggcatcgacatcggcgagtacgggctggcctggaccatcatcaacatcgacctcaagaacaagaagatcaacaagatcagcaagcagggcttcatctacgagccgctgacccacaaggtgcgcgactacgtggccaccatcaaggacaaccaggtccgcgggacgttcggcatgcccgacaccaagctggcccggctccgcgagaacgcgatcacctccctgcggaaccaggtgcacgacatcgccatgcgctacgacgccaagcccgtgtacgagttcgagatcagcaacttcgagaccgggtccaacaaggtcaaggtgatctacgacagcgtgaagcgggccgacatcggccgcggccagaacaacacggaggcggacaacaccgaggtcaacctggtgtgggggaagacctccaagcagttcggcagccagatcggggcctacgccacctcctacatctgcagcttctgcggctacagcccctactacgagttcgagaactccaagagcggggacgaggagggcgcccgggacaacctctaccagatgaagaagctgtcccgcccgagcctggaggacttcctccagggcaaccccgtgtacaagacgttccgggacttcgacaagtacaagaacgaccagcgcctgcagaagaccggggacaaggacggcgagtggaagacccaccgggggaacaccgccatctacgcgtgccagaagtgctga

SEQ ID NO: 11249 - RNA, 3480 nt, synthetic construct
  misc_feature 1..3480: note = Cas13a variant__Leptotrichia buccalis__WP_015770004.1__Cas13a
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgagatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaagaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctacgtaaactcctgagctacgatagaaagttgaaaaacgccgtgatgaagtccgtagtcgacatcctgaaagaatatggcttcgtggctacattcaagattggggccgataagaaaatcggaatacagactttagagtcagaaaagattgttcacctcaaaaatctgaagaaaaagaaacttatgaccgacaggaacagcgaggagctgtgcaagttggtgaagatcatgtttgaatacaaaatggaggaaaagaaatctgagaactga

SEQ ID NO: 11250 - RNA, 3480 nt, synthetic construct
  misc_feature 1..3480: note = Cas13a variant__Leptotrichia buccalis__WP_015770004.1__Cas13a(R472A,H477A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattgcacatggaatagtggccttcaatctggagctcgaaggtaaggatatctttgctttcaaaaacattgccccatcagagatcagtaagaaaatgtttcagaatgaaattaacgagaagaagctgaaacttaagatcttccggcaactgaatagcgcaaacgtttttcgatacttggagaaatataagatactcaattacctgaaacgcacgagattcgaatttgtgaacaagaatatcccgttcgtcccctcctttactaaattatattctaggattgacgacctgaagaacagcctaggcatctactggaagacccctaaaacaaatgatgacaacaagactaaagagattatcgatgctcagatatacctcctgaagaatatttattacggggagttccttaactatttcatgtcaaacaatggaaactttttcgagatcagtaaagagattatcgaattgaataagaacgacaagcggaatctgaaaaccggcttttacaagctccagaaattcgaggatatacaggaaaagatcccaaaagagtatctggccaacattcaatccctttacatgatcaatgcgggtaaccaggacgaagaggagaaggatacatatattgactttatccagaagatattcctgaaagggtttatgacctacttggccaataacggacgcctcagcctgatttacatcggctctgatgaagagacgaatacttcattagcagaaaagaaacaagagttcgacaagtttctgaaaaagtatgaacagaacaataacatcaagattccctacgagatcaatgagttcctaagagaaattaaactcggcaacatactgaagtatacagagaggcttaatatgttttacttgatcctgaaactcctgaaccacaaggaattaaccaacctgaaagggagtcttgagaagtatcagagcgctaataaggaagaggccttctccgatcagttggagctcattaacctgctaaatctggacaacaatcgtgtgactgaagattttgagctcgaagctgacgagatcggaaaattcctggacttcaacggtaataaggtaaaagataacaaggagcttaaaaagtttgacacaaataaaatttacttcgatggcgaaaacatcataaagcatcgggccttttataatatcaagaaatacgggatgttgaacctgttagagaagattgcagacaaagccggatacaagatctctattgaagaactcaaaaagtattcgaataagaaaaacgaaatcgagaagaatcacaaaatgcaagagaacctgcaccgaaagtacgctagacctaggaaagatgaaaagttcaccgacgaggattatgaaagctacaagcaggcgatagagaacattgaagagtatacgcatcttaaaaataaggttgagtttaacgaactgaatttgctccagggcctgctactgcgcatcctccaccggctggtgggttacacctccatctgggagagagaccttaggttccgcttgaaaggggaatttccagagaaccagtatattgaagagatattcaattttgagaacaagaaaaatgtcaagtacaagggcggacaaatcgtggaaaaatacattaagttctataaagagctgcatcagaacgatgaagtcaagatcaataaatactcaagtgcaaacattaaggtgttaaaacaggagaagaaggacctctatatccgaaattacatagcccactttaactatatcccccacgctgagatttctctgcttgaagttctggagaatctacggaaactcctgagctacgatcgtaagttgaaaaacgccgtgatgaagtccgtagtcgacatcctgaaagaatatggcttcgtggcaacattcaagattggggccgataagaaaatcggaatacagactttagagtcagaaaagattgttcatctcaaaaatctgaagaaaaagaaacttatgaccgacagaaacagcgaggagctgtgcaagttggtgaagatcatgtttgaatacaaaatggaggaaaagaaatctgagaactga

SEQ ID NO: 11251 - RNA, 3480 nt, synthetic construct
  misc_feature 1..3480: note = Cas13a variant__Leptotrichia buccalis__WP_015770004.1__Cas13a(R1048A,H1053A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgagatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaagaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatcgcgaattacatagcagcctttaactatatcccccacgctgagatttctctgcttgaagttctggagaatctacggaaactcctgagctacgatcgtaagttgaaaaacgccgtgatgaagtccgtagtcgacatcctgaaagaatatggcttcgtggcaacattcaagattggggccgataagaaaatcggaatacagactttagagtcagaaaagattgttcatctcaaaaatctgaagaaaaagaaacttatgaccgacagaaacagcgaggagctgtgcaagttggtgaagatcatgtttgaatacaaaatggaggaaaagaaatctgagaactga

SEQ ID NO: 11252 - RNA, 3480 nt, synthetic construct
  misc_feature 1..3480: note = Cas13a variant__Leptotrichia buccalis__WP_015770004.1__Cas13a(R472A,H477A,R1048A,H1053A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattgcacatggaatagtggccttcaatctggagctcgaaggtaaggatatctttgctttcaaaaacattgccccatcagagatcagtaagaaaatgtttcagaatgaaattaacgagaagaagctgaaacttaagatcttccggcaactgaatagcgcaaacgtttttcgatacttggagaaatataagatactcaattacctgaaacgcacgagattcgaatttgtgaacaagaatatcccgttcgtcccctcctttactaaattatattctaggattgacgacctgaagaacagcctaggcatctactggaagacccctaaaacaaatgatgacaacaagactaaagagattatcgatgctcagatatacctcctgaagaatatttattacggggagttccttaactatttcatgtcaaacaatggaaactttttcgagatcagtaaagagattatcgaattgaataagaacgacaagcggaatctgaaaaccggcttttacaagctccagaaattcgaggatatacaggaaaagatcccaaaagagtatctggccaacattcaatccctttacatgatcaatgcgggtaaccaggacgaagaggagaaggatacatatattgactttatccagaagatattcctgaaagggtttatgacctacttggccaataacggacgcctcagcctgatttacatcggctctgatgaagagacgaatacttcattagcagaaaagaaacaagagttcgacaagtttctgaaaaagtatgaacagaacaataacatcaagattccctacgagatcaatgagttcctaagagaaattaaactcggcaacatactgaagtatacagagaggcttaatatgttttacttgatcctgaaactcctgaaccacaaggaattaaccaacctgaaagggagtcttgagaagtatcagagcgctaataaggaagaggccttctccgatcagttggagctcattaacctgctaaatctggacaacaatcgtgtgactgaagattttgagctcgaagctgacgagatcggaaaattcctggacttcaacggtaataaggtaaaagataacaaggagcttaaaaagtttgacacaaataaaatttacttcgatggcgaaaacatcataaagcatcgggccttttataatatcaagaaatacgggatgttgaacctgttagagaagattgcagacaaagccggatacaagatctctattgaagaactcaaaaagtattcgaataagaaaaacgaaatcgagaagaatcacaaaatgcaagagaacctgcaccgaaagtacgctagacctaggaaagatgaaaagttcaccgacgaggattatgaaagctacaagcaggcgatagagaacattgaagagtatacgcatcttaaaaataaggttgagtttaacgaactgaatttgctccagggcctgctactgcgcatcctccaccggctggtgggttacacctccatctgggagagagaccttaggttccgcttgaaaggggaatttccagagaaccagtatattgaagagatattcaattttgagaacaagaaaaatgtcaagtacaagggcggacaaatcgtggaaaaatacattaagttctataaagagctgcatcagaacgatgaagtcaagatcaataaatactcaagtgcaaacattaaggtgttaaaacaggagaagaaggacctctatatcgccaattacatagctgcctttaactatatcccccacgcagagatttctctgcttgaagttctggagaatctacgaaaactcctgagctacgatcggaagttgaaaaacgccgtgatgaagtccgtagtcgacatcctgaaagaatatggcttcgtggctacattcaagattggggccgataagaaaatcggaatacagactttagagtcagaaaagattgttcacctcaaaaatctgaagaaaaagaaacttatgaccgaccgtaacagcgaggagctgtgcaagttggtgaagatcatgtttgaatacaaaatggaggaaaagaaatctgagaactga

SEQ ID NO: 11253 - RNA, 3480 nt, synthetic construct
  misc_feature 1..3480: note = Cas13a variant__Leptotrichia buccalis__WP_015770004.1__Cas13a(R1079A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgagatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaagaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctacgtaaactcctgagctacgatgccaagttgaaaaacgctgtgatgaagtccgtagtcgacatcctgaaagaatatggcttcgtggccacattcaagattggggcagataagaaaatcggaatacagactttagagtcagaaaagattgttcacctcaaaaatctgaagaaaaagaaacttatgaccgacagaaacagcgaggagctgtgcaagttggtgaagatcatgtttgaatacaaaatggaggaaaagaaatctgagaactga

SEQ ID NO: 11254 - RNA, 3480 nt, synthetic construct
  misc_feature 1..3480: note = Cas13a variant__Leptotrichia buccalis__WP_015770004.1__Cas13a(E299A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgctatgtctcagctgcttaagaattatgtgtacaaacgcctgtccaacatttcaaatgataagatcaagcgaatatttgagtatcaaaacttgaaaaagctcattgagaacaaactgttaaataagctggacacatacgtgagaaactgtggcaaatataattactatctccaggatggtgaaatcgcaaccagcgacttcatcgccaggaaccggcagaatgaggcttttcttcgtaacattatcggggtcagttctgttgcctacttctccctgcgcaatattttggaaactgagaacgaaaatgatataacaggaagaatgaggggcaagaccgtgaagaacaataaaggcgaggagaagtacgtaagcggggaagtggacaaaatctataacgagaataagaaaaacgaagtcaaggagaatctaaagatgttctactcgtatgattttaacatggacaacaaaaatgaaattgaggatttctttgcgaacatcgacgaggcaatctcttccattcggcatggaatagtgcacttcaatctggaactcgagggtaaggatatctttgccttcaaaaacattgctccatcagaaatcagtaagaaaatgtttcagaatgagattaacgaaaagaagctgaaacttaagatcttccgacaactgaatagcgccaacgtttttcgctacttggagaaatataagatactcaattacctgaaaagaacgaggttcgagtttgtgaacaagaatatcccgttcgtcccctcctttactaaattatattctcggattgacgacctgaagaacagcctaggcatctactggaagacccctaaaacaaatgatgacaacaagactaaagaaattatcgatgcacagatatacctcctgaagaatatttattacggggagttccttaactatttcatgtcaaacaatggaaactttttcgaaatcagtaaagagattatcgagttgaataagaacgacaagcgcaatctgaaaaccggcttttacaagctccagaaattcgaagatatacaggagaagatcccaaaagaatatctggctaacattcaatccctttacatgatcaatgccggtaaccaggacgaggaagagaaggatacatatattgactttatccagaagatattcctgaaagggtttatgacctacttggcgaataacggaagactcagcctgatttacatcggctctgatgaggaaacgaatacttcattagccgagaagaaacaagagttcgacaagtttctgaaaaagtatgaacagaacaataacatcaagattccctacgaaatcaatgagttcctaagggagattaaactcggcaacatactgaagtatacagaacgtcttaatatgttttacttgatcctgaaactcctgaaccataaggagttaaccaacctgaaagggagtcttgaaaagtatcagagcgcaaataaggaggaggctttctccgatcagttggaactcattaacctgctaaatctggacaacaatcgggtgactgaggattttgaactcgaggccgacgaaatcggaaaattcctggacttcaacggtaataaggtaaaagataacaaggagcttaaaaagtttgacacaaataaaatttacttcgatggcgagaacatcataaagcaccgagctttttataatatcaagaaatacgggatgttgaacctgttagaaaagattgccgacaaagcaggatacaagatctctattgaggaactcaaaaagtattcgaataagaaaaacgagatcgaaaagaatcacaaaatgcaagagaacctgcatagaaagtacgccaggcctcgcaaagatgagaagttcaccgacgaagattatgagagctacaagcaggctatagaaaacattgaggaatatacgcaccttaaaaataaggttgagtttaacgagctgaatttgctccagggcctgctactgcggatcctccatagactggtgggttacacctccatctgggaaagggaccttcgcttccgattgaaaggggagtttccagaaaaccagtatattgaggaaatattcaattttgagaacaagaaaaatgtcaagtacaagggcggacaaatcgtggagaaatacattaagttctataaagaactgcaccagaacgatgaggtcaagatcaataaatactcaagtgcgaacattaaggtgttaaaacaggaaaagaaggacctctatatccggaattacatagcacactttaactatatcccccatgccgagatttctctgcttgaggttctggaaaatctacgtaaactcctgagctacgatagaaagttgaaaaacgctgtgatgaagtccgtagtcgacatcctgaaagagtatggcttcgtggccacattcaagattggggcagataagaaaatcggaatacagactttagaatcagagaagattgttcacctcaaaaatctgaagaaaaagaaacttatgaccgacaggaacagcgaggaactgtgcaagttggtgaagatcatgtttgagtacaaaatggaagagaagaaatctgaaaactga

SEQ ID NO: 11255 - RNA, 3480 nt, synthetic construct
  misc_feature 1..3480: note = Cas13a variant__Leptotrichia buccalis__WP_015770004.1__Cas13a(K310A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaagaagatattgccaaactcgtgttagagatcgaaaatctgaccaaacttgagaagtataaaataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaggaactcaatgacaagaacataaaatacgccttttgccacttcgtcgaaatcgagatgtctcagctgcttaagaattatgtgtacgctcgcctgtccaacatttcaaatgataaaatcaagcgaatatttgagtatcaaaacttgaagaaactcattgaaaacaagctgttaaataaactggacacatacgtgagaaactgtggcaagtataattactatctccaggatggtgagatcgcaaccagcgacttcatcgccaggaaccggcagaatgaggcttttcttcgtaacattatcggggtcagttctgttgcctacttctccctgcgcaatattttggaaactgaaaacgagaatgatataacaggaagaatgaggggcaaaaccgtgaagaacaataagggcgaggaaaaatacgtaagcggggaggtggacaagatctataacgaaaataaaaagaacgaggtcaaagaaaatctaaagatgttctactcgtatgattttaacatggacaacaagaatgagattgaggatttctttgcgaacatcgacgaagcaatctcttccattcggcatggaatagtgcacttcaatctggagctcgaaggtaaagatatctttgccttcaagaacattgctccatcagagatcagtaaaaagatgtttcagaatgaaattaacgagaaaaagctgaaacttaaaatcttccgacaactgaatagcgccaacgtttttcgctacttggagaagtataaaatactcaattacctgaagagaacgaggttcgaatttgtgaacaaaaatatcccgttcgtcccctcctttactaagttatattctcggattgacgacctgaaaaacagcctaggcatctactggaagacccctaagacaaatgatgacaacaaaactaaggagattatcgatgcacagatatacctcctgaaaaatatttattacggggagttccttaactatttcatgtcaaacaatggaaactttttcgaaatcagtaaggagattatcgaattgaataaaaacgacaagcgcaatctgaagaccggcttttacaaactccagaagttcgaggatatacaggagaaaatcccaaaggaatatctggctaacattcaatccctttacatgatcaatgccggtaaccaggacgaagaggagaaagatacatatattgactttatccagaagatattcctgaaggggtttatgacctacttggcgaataacggaagactcagcctgatttacatcggctctgatgaagagacgaatacttcattagccgaaaagaagcaagagttcgacaaatttctgaagaaatatgaacagaacaataacatcaagattccctacgagatcaatgagttcctaagggaaattaagctcggcaacatactgaaatatacagagcgtcttaatatgttttacttgatcctgaagctcctgaaccataaagaattaaccaacctgaaggggagtcttgagaaatatcagagcgcaaataaggaagaggctttctccgatcagttggagctcattaacctgctaaatctggacaacaatcgggtgactgaagattttgagctcgaagccgacgagatcggaaagttcctggacttcaacggtaataaagtaaaggataacaaagagcttaagaaatttgacacaaataagatttacttcgatggcgaaaacatcataaaacaccgagctttttataatatcaagaagtacgggatgttgaacctgttagagaaaattgccgacaaggcaggatacaaaatctctattgaggaactcaagaaatattcgaataagaagaacgaaatcgagaaaaatcacaagatgcaagagaacctgcatagaaaatacgccaggcctcgcaaggatgaaaaattcaccgacgaggattatgaaagctacaagcaggctatagagaacattgaagagtatacgcaccttaagaataaagttgagtttaacgaactgaatttgctccagggcctgctactgcggatcctccatagactggtgggttacacctccatctgggagagggaccttcgcttccgattgaagggggaatttccagagaaccagtatattgaagagatattcaattttgagaacaaaaagaatgtcaaatacaagggcggacaaatcgtggaaaagtacattaaattctataaggagctgcaccagaacgatgaagtcaaaatcaataagtactcaagtgcgaacattaaagtgttaaagcaggagaaaaaggacctctatatccggaattacatagcacactttaactatatcccccatgccgagatttctctgcttgaagttctggagaatctacgtaagctcctgagctacgatagaaaattgaagaacgctgtgatgaaatccgtagtcgacatcctgaaggaatatggcttcgtggccacattcaaaattggggcagataagaagatcggaatacagactttagagtcagaaaagattgttcacctcaagaatctgaaaaagaaaaagctgatgaccgacaggaacagcgaggagctttgcaagttggtgaaaatcatgtttgaatacaagatggaggagaaaaagtctgaaaactga

SEQ ID NO: 11256 - RNA, 3480 nt, synthetic construct
  misc_feature 1..3480: note = Cas13a variant__Leptotrichia buccalis__WP_015770004.1__Cas13a(N314A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaagaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaggaactcaatgacaagaacataaaatacgccttttgccacttcgtcgaaatcgagatgtctcagctgcttaagaattatgtgtacaaacgcctgtccgctatttcaaacgataagatcaagcgaatatttgagtatcaaaatttgaaaaagctcattgaaaacaaactgttaaacaagctggacacatacgtgagaaattgtggcaaatataactactatctccaggatggtgagatcgcaaccagcgacttcatcgccaggaatcggcagaacgaggcttttcttcgtaatattatcggggtcagttctgttgcctacttctccctgcgcaacattttggaaactgaaaatgagaacgatataacaggaagaatgaggggcaagaccgtgaagaataacaaaggcgaggaaaagtacgtaagcggggaggtggacaaaatctataatgaaaacaagaaaaatgaggtcaaggaaaacctaaagatgttctactcgtatgattttaatatggacaacaaaaacgagattgaggatttctttgcgaatatcgacgaagcaatctcttccattcggcatggaatagtgcacttcaacctggagctcgaaggtaaggatatctttgccttcaaaaatattgctccatcagagatcagtaagaaaatgtttcagaacgaaattaatgagaagaagctgaaacttaagatcttccgacaactgaacagcgccaatgtttttcgctacttggagaaatataagatactcaactacctgaaaagaacgaggttcgaatttgtgaataagaacatcccgttcgtcccctcctttactaaattatattctcggattgacgacctgaagaatagcctaggcatctactggaagacccctaaaacaaacgatgacaataagactaaagagattatcgatgcacagatatacctcctgaagaacatttattacggggaatttcttaattatttcatgtcaaacaacggaaatttcttcgagatcagtaaagagattatcgaattgaacaagaatgacaagcgcaacctgaaaaccggcttttacaagctccagaaattcgaggatatacaggaaaagatcccaaaagagtatctggctaatattcaatccctttacatgatcaacgccggtaatcaggacgaagaggagaaggatacatatattgactttatccagaagatattcctgaaagggtttatgacctacttggcgaacaatggaagactcagcctgatttacatcggctctgatgaagagacgaacacttcattagccgaaaagaaacaagagttcgacaagtttctgaaaaagtatgaacagaataacaatatcaagattccctacgagatcaacgagttcctaagggaaattaaactcggcaatatactgaagtatacagagcgtcttaacatgttttacttgatcctgaaactcctgaatcataaggaattaaccaacctgaaagggagtcttgagaagtatcagagcgcaaacaaggaagaggctttctccgatcagttggagctcattaatctgctaaacctggacaataaccgggtgactgaagattttgagctcgaagccgacgagatcggaaaattcctggacttcaatggtaacaaggtaaaagataataaggagcttaaaaagtttgacacaaacaaaatttacttcgatggcgaaaatatcataaagcaccgagctttttataacatcaagaaatacgggatgttgaatctgttagagaagattgccgacaaagcaggatacaagatctctattgaggaactcaaaaagtattcgaacaagaaaaatgaaatcgagaagaaccacaaaatgcaagagaatctgcatagaaagtacgccaggcctcgcaaagatgaaaagttcaccgacgaggattatgaaagctacaagcaggctatagagaacattgaagagtatacgcaccttaaaaacaaggttgagtttaatgaactgaacttgctccagggcctgctactgcggatcctccatagactggtgggttacacctccatctgggagagggaccttcgcttccgattgaaaggggaatttccagagaatcagtatattgaagagatattcaactttgagaataagaaaaacgtcaagtacaagggcggacaaatcgtggaaaaatacattaagttctataaagagctgcaccagaatgatgaagtcaagatcaacaaatactcaagtgcgaatattaaggtgttaaaacaggagaagaaggacctctatatccggaactacatagcacactttaattatatcccccatgccgagatttctctgcttgaagttctggagaacctacgtaaactcctgagctacgatagaaagttgaaaaatgctgtgatgaagtccgtagtcgacatcctgaaagaatatggcttcgtggccacattcaagattggggcagataagaaaatcggaatacagactttagagtcagaaaagattgttcacctcaaaaacctgaagaaaaagaaacttatgaccgacaggaatagcgaggagctgtgcaagttggtgaagatcatgtttgaatacaaaatggaggaaaagaaatctgagaactga

SEQ ID NO: 11257 - RNA, 3480 nt, synthetic construct
  misc_feature 1..3480: note = Cas13a variant__Leptotrichia buccalis__WP_015770004.1__Cas13a(R1072A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgagatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaagaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctagccaaactcctgagctacgatcgtaagttgaaaaacgctgtgatgaagtccgtagtcgacatcctgaaagaatatggcttcgtggccacattcaagattggggcagataagaaaatcggaatacagactttagagtcagaaaagattgttcacctcaaaaatctgaagaaaaagaaacttatgaccgacagaaacagcgaggagctgtgcaagttggtgaagatcatgtttgaatacaaaatggaggaaaagaaatctgagaactga

SEQ ID NO: 11258 - RNA, 3480 nt, synthetic construct
  misc_feature 1..3480: note = Cas13a variant__Leptotrichia buccalis__WP_015770004.1__Cas13a(D1078A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgagggaaagagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataagataagggagttctaccatgaaattatcgggcggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgagatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaagaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctacgtaaactcctgagctacgccagaaagttgaaaaacgctgtgatgaagtccgtagtcgatatcctgaaagaatatggcttcgtggccacattcaagattggggcagacaagaaaatcggaatacagactttagagtcagaaaagattgttcacctcaaaaatctgaagaaaaagaaacttatgaccgataggaacagcgaggagctgtgcaagttggtgaagatcatgtttgaatacaaaatggaggaaaagaaatctgagaactga

SEQ ID NO: 11259 - RNA, 3480 nt, synthetic construct
  misc_feature 1..3480: note = Cas13a variant__Leptotrichia buccalis__WP_015770004.1__Cas13a(R1079A,K1080A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgaggggaaaagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataaaataagggagttctaccatgaaattatcggacggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgaaatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaggaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctacgtaaactcctgagctacgatgccgctttgaagaacgccgtgatgaaatccgtagtcgacatcctgaaggaatatggcttcgtggcaacattcaaaattggggccgataagaagatcggaatacagactttagagtcagaaaagattgttcacctcaagaatctgaaaaagaaaaagctgatgaccgacagaaacagcgaggagctttgcaagttggtgaaaatcatgtttgaatacaagatggaggaaaagaagtctgagaactga

SEQ ID NO: 11260 - RNA, 3480 nt, synthetic construct
  misc_feature 1..3480: note = Cas13a variant__Leptotrichia buccalis__WP_015770004.1__Cas13a(K1080A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgaggggaaaagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataaaataagggagttctaccatgaaattatcggacggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgaaatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaggaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctacgtaaactcctgagctacgatagagccttgaagaacgctgtgatgaaatccgtagtcgacatcctgaaggaatatggcttcgtggccacattcaaaattggggcagataagaagatcggaatacagactttagagtcagaaaagattgttcacctcaagaatctgaaaaagaaaaagctgatgaccgacaggaacagcgaggagctttgcaagttggtgaaaatcatgtttgaatacaagatggaggaaaagaagtctgagaactga

SEQ ID NO: 11261 - RNA, 3480 nt, synthetic construct
  misc_feature 1..3480: note = Cas13a variant__Leptotrichia buccalis__WP_015770004.1__Cas13a(K1082A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgaggggaaaagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataaaataagggagttctaccatgaaattatcggacggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgaaatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaggaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctacgtaaactcctgagctacgatagaaagttggccaacgctgtgatgaaatccgtagtcgacatcctgaaggaatatggcttcgtggccacattcaaaattggggcagataagaagatcggaatacagactttagagtcagaaaagattgttcacctcaagaatctgaaaaagaaaaagctgatgaccgacaggaacagcgaggagctttgcaagttggtgaaaatcatgtttgaatacaagatggaggaaaagaagtctgagaactga

SEQ ID NO: 11262 - RNA, 3480 nt, synthetic construct
  misc_feature 1..3480: note = Cas13a variant__Leptotrichia buccalis__WP_015770004.1__Cas13a(K1087A)
  source 1..3480: mol_type = other RNA
atgaaggtgaccaaagtcggcgggatcagccacaagaaatacacatccgagggaagactggttaagtctgaatcagaggaaaacaggactgacgagcggctcagtgcccttctgaatatgcgcttggatatgtatattaaaaaccccagctccacggaaaccaaggagaatcagaagcgaataggtaaattaaagaaattcttttctaacaagatggtgtacctgaaagacaatacactatcgctcaagaacggcaagaaagagaatatcgatcgtgaatattcagagactgacattctggaaagcgatgtaagagacaagaaaaacttcgctgtgcttaagaaaatctacctgaatgagaacgtcaatagtgaggaattggaggtgtttaggaacgatattaagaaaaagctcaataagatcaactccctgaaatattctttcgaaaagaataaagcaaactaccaaaagataaacgagaataacatcgaaaaagttgaggggaaaagcaagcggaatattatctatgactactaccgcgagtccgccaaaagagatgcgtatgtgtcaaacgtcaaggaggcttttgacaaactgtacaaggaggaagatattgccaaactcgtgttagagatcgaaaatctgaccaaacttgagaagtataaaataagggagttctaccatgaaattatcggacggaagaacgacaaagagaattttgcaaagattatctatgaagagatccagaacgtaaataacatgaaagaattgattgagaaggttcctgatatgagtgagctgaagaaaagccaggtgttctacaagtattacctagacaaagaagaactcaatgacaagaacataaaatacgccttttgccacttcgtcgaaatcgagatgtctcagctgcttaagaattatgtgtacaaacgcctgtccaacatttcaaatgataagatcaagcgaatatttgagtatcaaaacttgaaaaagctcattgaaaacaaactgttaaataagctggacacatacgtgagaaactgtggcaaatataattactatctccaggatggtgagatcgctaccagcgacttcatcgcaaggaaccggcagaatgaagcctttcttcgtaacattatcggggtcagttctgttgcttacttctccctgcgcaatattttggagactgaaaacgagaatgatataacaggaagaatgaggggcaagaccgtgaagaacaataaaggcgaggaaaagtacgtaagcggggaggtggacaaaatctataacgaaaataagaaaaacgaggtcaaggaaaatctaaagatgttctactcgtatgattttaacatggacaacaaaaatgagattgaggatttctttgccaacatcgacgaagcgatctcttccattcggcatggaatagtgcacttcaatctggagctcgaaggtaaggatatctttgcattcaaaaacattgccccatcagagatcagtaagaaaatgtttcagaatgaaattaacgagaagaagctgaaacttaagatcttccgacaactgaatagcgctaacgtttttcgctacttggagaaatataagatactcaattacctgaaaagaacgaggttcgaatttgtgaacaagaatatcccgttcgtcccctcctttactaaattatattctcggattgacgacctgaagaacagcctaggcatctactggaagacccctaaaacaaatgatgacaacaagactaaagagattatcgatgcccagatatacctcctgaagaatatttattacggggagttccttaactatttcatgtcaaacaatggaaactttttcgaaatcagtaaagagattatcgaattgaataagaacgacaagcgcaatctgaaaaccggcttttacaagctccagaaattcgaggatatacaggaaaagatcccaaaagagtatctggcaaacattcaatccctttacatgatcaatgctggtaaccaggacgaagaggagaaggatacatatattgactttatccagaagatattcctgaaagggtttatgacctacttggccaataacggaagactcagcctgatttacatcggctctgatgaagagacgaatacttcattagcggaaaagaaacaagagttcgacaagtttctgaaaaagtatgaacagaacaataacatcaagattccctacgagatcaatgagttcctaagggaaattaaactcggcaacatactgaagtatacagagcgtcttaatatgttttacttgatcctgaaactcctgaaccataaggaattaaccaacctgaaagggagtcttgagaagtatcagagcgccaataaggaagaggcattctccgatcagttggagctcattaacctgctaaatctggacaacaatcgggtgactgaagattttgagctcgaagctgacgagatcggaaaattcctggacttcaacggtaataaggtaaaagataacaaggagcttaaaaagtttgacacaaataaaatttacttcgatggcgaaaacatcataaagcaccgagccttttataatatcaagaaatacgggatgttgaacctgttagagaagattgctgacaaagccggatacaagatctctattgaggaactcaaaaagtattcgaataagaaaaacgaaatcgagaagaatcacaaaatgcaagagaacctgcatagaaagtacgcaaggcctcgcaaagatgaaaagttcaccgacgaggattatgaaagctacaagcaggccatagagaacattgaagagtatacgcaccttaaaaataaggttgagtttaacgaactgaatttgctccagggcctgctactgcggatcctccatagactggtgggttacacctccatctgggagagggaccttcgcttccgattgaaaggggaatttccagagaaccagtatattgaagagatattcaattttgagaacaagaaaaatgtcaagtacaagggcggacaaatcgtggaaaaatacattaagttctataaagagctgcaccagaacgatgaagtcaagatcaataaatactcaagtgctaacattaaggtgttaaaacaggagaagaaggacctctatatccggaattacatagcgcactttaactatatcccccatgcagagatttctctgcttgaagttctggagaatctacgtaaactcctgagctacgatagaaagttgaaaaacgccgtgatggcttccgtagtcgacatcctgaaggaatatggcttcgtggccacattcaaaattggggcagataagaagatcggaatacagactttagagtcagaaaagattgttcacctcaagaatctgaaaaagaaaaagctgatgaccgacaggaacagcgaggagctttgcaagttggtgaaaatcatgtttgaatacaagatggaggaaaagaagtctgagaactga

SEQ ID NO: 11263 - RNA, 4170 nt, synthetic construct
  misc_feature 1..4170: note = Cas13a variant__Leptotrichia shahii__WP_018451595.1__Cas13a
  source 1..4170: mol_type = other RNA
atgggcaacctgttcgggcacaagagatggtacgaggtgagggacaaaaaggattttaaaatcaagcggaaagtcaaggttaagcgcaattatgacggaaacaaatacattctcaatataaacgaaaataacaataaggagaaaatcgataacaataagttcattcgaaaatatatcaactacaagaagaatgacaacattcttaaagaatttacccgtaagttccatgccggtaatatcctgtttaaattgaagggcaaagaggggataatcagaattgaaaacaatgatgacttcttagagacagaggaagtggtactgtatatcgaggcttacggaaagagcgaaaaactaaaggcactcggcattactaagaaaaagatcatagatgaggccattaggcagggtatcacgaaagacgataagaaaattgagatcaagcggcaagaaaacgaggaagagatcgaaattgacatacgcgatgagtataccaacaagacactgaatgactgctccatcattcttagaatcatagagaacgatgaactggagactaaaaagtctatttacgaaatctttaaaaatatcaacatgtcattgtacaagattatcgagaaaattatagaaaatgagaccgagaaggtgttcgaaaacaggtattacgaggaacacctccgggagaagctgctgaaagacgacaagatcgatgtcattctcacaaattttatggaaatccgcgagaaaatcaagagtaacttagagattctggggttcgtgaaattttatcttaatgttggaggcgacaagaagaaaagcaagaacaaaaagatgttggtggagaaaatactgaatatcaacgtcgatctaaccgtggaagacattgcggatttcgtaatcaaggaactcgagttttggaatattactaaacgaatcgagaaggttaagaaagtgaacaatgagttcctggaaaagagaaggaaccggacatacataaaatcctatgtccttctggacaagcatgaaaaattcaagatcgagcgtgaaaacaagaaagataagattgtgaaatttttcgtggagaatatcaagaacaattctattaaagagaagatcgaaaagatattggctgagtttaaaattgacgaactcatcaagaaactggagaaggaattaaagaagggcaactgtgataccgagattttcgggatctttaagaaacactacaaggtcaatttcgactcgaaaaagtttagcaaaaagtcagatgaggaaaaagagctgtataagataatctaccgctacctcaagggaagaattgagaaaatccttgttaacgaacagaaggtgaggctgaaaaagatggagaaaattgaaatcgagaagatattgaatgaaagtattctatccgagaagatcctgaaacgggtaaagcagtatacgctcgaacatatcatgtacctgggtaaacttcgacacaacgacattgacatgactaccgtgaatacagatgacttctctcgcctgcacgccaaggaggagttggatctcgaactgatcacctttttcgcaagcactaacatggagttaaataaaatattttccagagaaaacattaataacgacgagaatatcgatttctttggcggggacagggaaaagaactatgtcctggataagaaaattctaaactcaaagatcaaaattatccgggacctcgatttcatagacaataagaacaatatcacaaacaatttcattcgcaaatttaccaagatcggaacgaacgagagaaataggattctgcatgccatcagtaaggagcgtgatcttcagggcactcaagacgattacaacaaagtgataaatattatccagaacttgaagatcagcgacgaagaggtttctaaagctctgaatctcgacgtggtcttcaaggataaaaagaacattataacaaagatcaatgacattaaaatctccgaagagaacaataacgatattaagtatctgccctcatttagcaaagtgcttcctgaaatcctgaacttgtaccggaataacccaaagaatgagccgttcgacaccatagagactgagaaaatcgtactcaacgcactgatttatgttaataaggaattatacaaaaagctgatcctagaagatgacctcgaggaaaacgagagtaagaatatttttctgcaggagcttaaaaagacattgggtaacatcgatgaaatagacgagaatattatcgaaaactactataaaaatgcccagatctctgcttccaaggggaacaataaagccattaagaagtaccagaaaaaggtgatcgagtgctatataggatacctgcgaaagaactatgaggaactcttcgattttagcgacttcaaaatgaatattcaagagatcaaaaagcagattaaggatatcaacgacaataaaacctacgaaagaataacggtcaagacctcggataaaacaattgtgatcaacgacgactttgagtatatcatttctatcttcgcgctgttaaactccaatgcagtcattaacaagataaggaatcgctttttcgccacttcagtgtggctgaacaccagtgaataccagaatatcattgatatccttgacgagatcatgcaattgaacacactccggaatgagtgtattactgaaaactggaatctgaacctagaggaatttatacagaaaatgaaggagatcgaaaaggatttcgacgatttcaaaattcagaccaagaaagagatctttaataactactatgaggacattaagaataacatcctgacagagttcaaagatgacataaatggctgcgatgttctcgaaaagaaactggaaaagatcgtgatttttgacgatgagaccaagttcgaaatcgacaaaaagagcaacattcttcaagacgagcagagaaaattgtccaacatcaataagaaagatctgaagaagaaagtagaccagtacataaaggataaagaccaggagattaagtctaaaatcttatgtaggattatctttaacagcgatttcctcaagaagtataaaaaggaaatagacaatctgatcgaggatatggaatcagagaacgagaataaatttcaagaaatttactatcccaaggagcgcaaaaacgaactttacatctataagaagaatctgttcttgaacattggcaatcctaactttgacaaaatctacgggctcataagtaatgatattaagatggctgacgccaaattcctgtttaacatcgatggaaagaatatccggaaaaacaagatttccgagatcgacgcaatactgaaaaatctaaacgataagctcaacggttacagcaaggaatataaagagaagtacattaaaaagctgaaagagaatgacgacttcttcgctaagaacatccagaataagaactataaatcttttgaaaaggattacaatcgagtctcagagtataaaaagattcgtgaccttgtggagttcaactacttgaataaaatcgaaagttatctgatagatatcaactggaagttagccattcagatggcgagatttgaaagggacatgcactacatcgttaatggcctccgcgagctggggattatcaaacttagcggatacaacactggcatttcccgggcctatccaaaaagaaatggttctgatgggttctacacgacaaccgcatattacaagtttttcgacgaggaatcgtataaaaagtttgagaaaatctgctacggcttcggaatagatctgagcgaaaactccgagattaataagcccgaaaacgagtcaatcaggaattatatcagtcatttttacattgtgcgaaaccctttcgctgactactctatagccgagcagatcgatcgcgtcagcaacctactctcctattcaactcggtacaataacagcacctatgcttctgtgtttgaagtattcaagaaagacgtgaatctggattacgacgagttgaagaaaaagtttaaactgattggcaacaatgatatcttagaaagactcatgaagccaaagaaagtttccgtcctggagcttgagagttataacagcgactacattaagaatctgatcatagaattgctcacaaaaatcgagaacaccaatgacactctgtga

SEQ ID NO: 11264 - RNA, 4170 nt, synthetic construct; identical to SEQ ID NO: 11263
  misc_feature 1..4170: note = Cas13a variant__Leptotrichia shahii__WP_018451595.1__Cas13a
  source 1..4170: mol_type = other RNA

SEQ ID NO: 11265 - RNA, 4305 nt, synthetic construct
  misc_feature 1..4305: note = Cas13a variant__Leptotrichia shahii__WP_018451595.1__Cas13a(long)
  source 1..4305: mol_type = other RNA
atgggcaacctgttcgggcacaagagatggtacgaggtgagggacaaaaaggattttaaaatcaagcggaaagtcaaggttaagcgcaattatgacggaaacaaatacattctcaatataaacgaaaataacaataaggagaaaatcgataacaataagttcattcgaaaatatatcaactacaagaagaatgacaacattcttaaagaatttacccgtaagttccatgccggtaatatcctgtttaaattgaagggcaaagaggggataatcagaattgaaaacaatgatgacttcttagagacagaggaagtggtactgtatatcgaggcttacggaaagagcgaaaaactaaaggcactcggcattactaagaaaaagatcatagatgaggccattaggcagggtatcacgaaagacgataagaaaattgagatcaagcggcaagaaaacgaggaagagatcgaaattgacatacgcgatgagtataccaacaagacactgaatgactgctccatcattcttagaatcatagagaacgatgaactggagactaaaaagtctatttacgaaatctttaaaaatatcaacatgtcattgtacaagattatcgagaaaattatagaaaatgagaccgagaaggtgttcgaaaacaggtattacgaggaacacctccgggagaagctgctgaaagacgacaagatcgatgtcattctcacaaattttatggaaatccgcgagaaaatcaagagtaacttagagattctggggttcgtgaaattttatcttaatgttggaggcgacaagaagaaaagcaagaacaaaaagatgttggtggagaaaatactgaatatcaacgtcgatctaaccgtggaagacattgcggatttcgtaatcaaggaactcgagttttggaatattactaaacgaatcgagaaggttaagaaagtgaacaatgagttcctggaaaagagaaggaaccggacatacataaaatcctatgtccttctggacaagcatgaaaaattcaagatcgagcgtgaaaacaagaaagataagattgtgaaatttttcgtggagaatatcaagaacaattctattaaagagaagatcgaaaagatattggctgagtttaaaattgacgaactcatcaagaaactggagaaggaattaaagaagggcaactgtgataccgagattttcgggatctttaagaaacactacaaggtcaatttcgactcgaaaaagtttagcaaaaagtcagatgaggaaaaagagctgtataagataatctaccgctacctcaagggaagaattgagaaaatccttgttaacgaacagaaggtgaggctgaaaaagatggagaaaattgaaatcgagaagatattgaatgaaagtattctatccgagaagatcctgaaacgggtaaagcagtatacgctcgaacatatcatgtacctgggtaaacttcgacacaacgacattgacatgactaccgtgaatacagatgacttctctcgcctgcacgccaaggaggagttggatctcgaactgatcacatttttcgcaagcaccaacatggagttaaataaaatattttccagagaaaacattaataacgacgagaatatcgatttctttggcggggacagggaaaagaactatgtcctggataagaaaattctaaactcaaagatcaaaattatccgggacctcgatttcatagacaataagaacaatatcacaaacaatttcattcgcaaatttaccaagatcggaacgaacgagagaaataggattctgcatgccatcagtaaggagcgtgatcttcagggcactcaagacgattacaacaaagtgataaatattatccagaacttgaagatcagcgacgaagaggtttctaaagctctgaatctcgacgtggtcttcaaggataaaaagaacattataacaaagatcaatgacattaaaatctccgaagagaacaataacgatattaagtatctgccctcatttagcaaagtgcttcctgaaatcctgaacttgtaccggaataacccaaagaatgagccgttcgacaccatagagactgagaaaatcgtactcaacgcactgatttatgttaataaggaattatacaaaaagctgatcctagaagatgacctcgaggaaaacgagagtaagaatatttttctgcaggagcttaaaaagacattgggtaacatcgatgaaatagacgagaatattatcgaaaactactataaaaatgcccagatctctgcttccaaggggaacaataaagccattaagaagtaccagaaaaaggtgatcgagtgctatataggatacctgcgaaagaactatgaggaactcttcgattttagcgacttcaaaatgaatattcaagagatcaaaaagcagattaaggatatcaacgacaataaaacctacgaaagaataacggtcaagacctcggataaaacaattgtgatcaacgacgactttgagtatatcatttctatcttcgcgctgttaaactccaatgcagtcattaacaagataaggaatcgctttttcgccacttcagtgtggctgaacaccagtgaataccagaatatcattgatatccttgacgagatcatgcaattgaacacactccggaatgagtgtattactgaaaactggaatctgaacctagaggaatttatacagaaaatgaaggagatcgaaaaggatttcgacgatttcaaaattcagaccaagaaagagatctttaataactactatgaggacattaagaataacatcctgacagagttcaaagatgacataaatggctgcgatgttctcgaaaagaaactggaaaagatcgtgatttttgacgatgagaccaagttcgaaatcgacaaaaagagcaacattcttcaagacgagcagagaaaattgtccaacatcaataagaaagatctgaagaagaaagtagaccagtacataaaggataaagaccaggagattaagtctaaaatcttatgtaggattatctttaacagcgatttcctcaagaagtataaaaaggaaatagacaatctgatcgaggatatggaatcagagaacgagaataaatttcaagaaatttactatcccaaggagcgcaaaaacgaactttacatctataagaagaatctgttcttgaacattggcaatcctaactttgacaaaatctacgggctcataagtaatgatattaagatggctgacgccaaattcctgtttaacatcgatggaaagaatatccggaaaaacaagatttccgagatcgacgcaatactgaaaaatctaaacgataagctcaacggttacagcaaggaatataaagagaagtacattaaaaagctgaaagagaatgacgacttcttcgctaagaacatccagaataagaactataaatcttttgaaaaggattacaatcgagtctcagagtataaaaagattcgtgaccttgtggagttcaactacttgaataaaatcgaaagttatctgatagatatcaactggaagttagccattcagatggcgagatttgaaagggacatgcactacatcgttaatggcctccgcgagctggggattatcaaacttagcggatacaacactggcatttcccgggcctatccaaaaagaaatggttctgatgggttctacacgacaaccgcatattacaagtttttcgacgaggaatcgtataaaaagtttgagaaaatctgctacggcttcggaatagatctgagcgaaaactccgagattaataagcccgaaaacgagtcaatcaggaattatatcagtcatttttacattgtgcgaaaccctttcgctgactactctatagccgagcagatcgatcgcgtcagcaacctactctcctattcaactcggtacaataacagcacctatgcttctgtgtttgaagtattcaagaaagacgtgaatctggattacgacgagttgaagaaaaagtttaaactgattggcaacaatgatatcttagaaagactcatgaagccaaagaaagtttccgtcctggagcttgagagttataacagcgactacattaagaatctgatcatagaattgctcacaaaaatcgagaacaccaatgacactctgaagaggcccgccgcaactaaaaaggccgggcaagctaaaaagaagaaaggatcttatccttacgatgtgccagactacgcgtatccgtacgatgtgcccgactatgcatacccttatgatgtcccagactacgcctga

SEQ ID NO: 11266 - RNA, 4158 nt, synthetic construct
  misc_feature 1..4158: note = Cas13a variant__Leptotrichia sp. oral__WP_021744063.1__Cas13a
  source 1..4158: mol_type = other RNA
atgggcaacctgttcgggcacaagagatggtacgaggtgagggacaaaaaggattttaaaatcaagcggaaagtcaaggttaagcgcaattatgacggaaacaaatacattctcaatataaacgaaaataacaataaggagaaaatcgataacaataagttcattggtgaatttgtgaactataaaaagaataacaatgtacttaaggagttcaaacgaaagtttcatgccggcaacatcctgttcaaattgaaggggaaagaagagattatccgtatagagaataacgacgactttttagaaaccgaggaagtggtcctgtacatcgaggtgtatggaaagagcgagaaactaaaggctctcgaaattacaaagaaaaagatcattgatgaggcaatcagacagggcataactaaagatgacaagaaaattgaaatcaagaggcaagagaacgaagaggagattgaaatcgatatccgggacgagtacacgaataagaccctgaacgattgctccattatacttcgcatcattgaaaatgacgagctggaaactaaaaagtctatctatgagatattcaaaaacattaatatgtcattgtacaagatcatcgagaaaattatcgaaaacgagacagaaaaggtttttgagaatagatactatgaggaacacctcagggagaagctgctgaaagataacaagattgacgtgatactcaccaatttcatggaaatccgggagaaaattaagagtaacttagaaatcatgggttttgtcaaattctacctgaatgtgagcggggacaagaagaaatccgagaacaagaaaatgtttgtagagaagatccttaatacaaacgttgatttgaccgtggaagacattgtcgatttcatagtgaaagagctgaagttctggaatatcactaaacgcattgaaaaggtgaagaaatttaacaacgagttcctagaaaatcgaagaaacaggacatatatcaagtcttacgtcctcctggacaaacatgagaagtttaaaattgagcgggaaaataagaaggataaaatcgttaagttctttgtggagaacatcaaaaataactcgataaaggagaaaattgaaaagatccttgccgagttcaagattaatgaactgatcaaaaagttggagaaagaactcaagaaaggaaactgtgacaccgagatatttggcattttcaagaagcactataaagtaaattttgattcaaagaaattcagcaacaagagtgacgaagagaaagaactgtacaagatcatttatcgttacttaaaaggccgcatcgagaagatactggtgaatgagcagaaggtcagactcaaaaagatggagaaaatcgaaattgaaaagatccttaacgagtccattctgtctgagaaaatcttgaagagggtgaagcagtacacgctagaacatataatgtatctggggaaactccggcacaatgatattgttaagatgactgtgaacaccgacgattttagccgactgcacgcgaaagaggaacttgacctggagttgatcacattctttgcttccactaatatggaactcaacaagatcttcaacggaaaagagaaggtcaccgacttctttggtttcaatctgaacggccagaagattacattaaaagagaaggtgccctcatttaaactgaatatcctaaagaaactcaacttcattaataacgaaaataacatagatgagaagctgagtcatttttacagcttccaaaaggaagggtatcttttgcgcaataaaatcctgcacaactcttacggaaatattcaggagaccaagaacctcaaaggcgaatatgagaatgtagagaagctgatcaaagaacttaaggtttccgacgaggaaatttcaaagagcctgagtttggatgtgatctttgagggtaaagtcgacataatcaacaagattaattctctcaaaatcggggaatacaaggataaaaagtatctgccttccttcagcaaaattgtgttagagatcacgagaaagtttagggagataaacaaggacaaactgttcgatattgaatcggagaagatcatcctaaacgccgtcaaatacgtgaataagattctctacgagaaaataacttctaacgaagagaatgaatttctgaagacacttccagacaagttggttaaaaagtccaacaataaaaaggagaacaaaaatctgctctcaatcgaagagtattacaagaacgcacaggtgagtagctccaagggagataaaaaggccattaaaaagtatcagaataaagtaaccaacgcttacctggaatatttagagaatactttcacagagatcattgacttttctaagttcaacctgaattacgatgaaatcaagaccaaaatagaggaacggaaggacaacaaaagcaagatcattatcgattcaattagtacgaatatcaacataaccaatgacattgagtatatcatctccattttcgcacttttgaacagcaacacatacatcaataaaatacgcaacagatttttcgccacttctgtctggctcgaaaagcaaaatggcaccaaagagtacgactatgagaacattatctcaattctggatgaagtgctactgatcaatctcctgagggagaacaatataacagacattcttgatttgaagaacgctatcatcgacgccaagattgttgaaaatgatgagacttacatcaaaaactatatttttgaaagtaatgaggagaagctgaaaaagcgtttattctgcgaggaactcgtggacaaagaagatatacggaagatctttgaggacgagaacttcaagtttaaatccttcattaagaaaaatgaaatcggcaactttaagatcaatttcgggattctgagcaaccttgagtgtaactctgaagtcgaggcgaaaaagataatcggaaagaactcgaaaaagctggagagctttattcagaatatcattgatgaatacaaatccaatatccgaaccttgttctcaagtgagttcctcgaaaagtataaagaggaaatagacaacctggtggaggatacagaatctgagaataagaacaagtttgagaaaatctactatccgaaggaacataaaaatgagctatacatttacaagaaaaacctgttcctcaatatcggtaaccccaattttgacaagatttatggcctgatcagcaaagatataaagaacgtagacaccaagattcttttcgacgatgacatcaaaaagaataaaatttccgaaatcgatgcaatattgaagaacctgaatgacaaattaaacgggtactcaaacgattataaggccaagtacgtgaataaactcaaggagaacgacgactttttcgctaaaaatatccagaacgaaaattatagctcttttggagagttcgagaaggattacaacaaagtttccgaatataagaagattagagatctggtcgagtttaattaccttaacaaaatcgaaagttacctgattgacatcaattggaagctagccatacagatggcaaggttcgagcgcgatatgcactatattgtgaacggcctccgggagctgggtatcatcaaattgagcgggtacaatactggcatttctagagcttatcctaagaggaacggatccgacggcttttacacgacaaccgcctattacaaattctttgacgaagagtcatataagaagttcgagaaaatctgctacgggttcggaatagatctgagtgaaaatagcgaaattaacaagccagagaatgagtcgatccgcaactacatttcccacttttatatcgtgcgaaaccccttcgcggactactctatagccgaacaaatcgatcgggtcagcaatttactctcatatagtactcgttacaacaattccacctatgcatctgtttttgaggtgttcaaaaaggacgtgaacctggattacgacgaacttaaaaagaagtttagactgattggtaataacgatatcttggagaggctcatgaaacctaagaaagtaagcgtcctggaactagagtcctataattcagactacattaagaacctgatcattgagcttctcacaaaaatcgaaaataccaacgatactctgtga

SEQ ID NO: 11267 - RNA, 3459 nt, synthetic construct
  misc_feature 1..3459: note = Cas13a variant__Leptotrichia wadei__WP_021746774.1__Cas13a
  source 1..3459: mol_type = other RNA
atgaaggtgaccaaagtcgacggcatcagccacaagaaatacattgaggaagggaagctggttaaatccacatctgaggaaaacagaacttcagagaggctcagtgaacttctgagcatacggttggatatctatattaagaatcccgacaacgcctccgaggaggaaaatcgcatccgacgtgagaacttaaagaaattcttttctaataaggtgctgcatctaaaagattcggtactctacctgaagaacagaaaagaaaagaatgctgtgcaggacaagaactattcagaggaggatattagcgaatacgaccttaaaaataagaacagtttctccgtcctgaaaaagatcttgctcaatgaggatgtgaactctgaggaactggaaatatttaggaaagacgttgaggcaaagctgaataaaatcaacagcctcaagtattccttcgaggaaaataaggccaactaccaaaagattaacgagaataacgtggaaaaggtcggaggtaaatcaaagcggaatatcatttatgattactaccgcgagagtgcgaaaagaaacgactatatcaataacgtgcaggaggcttttgataagttatacaagaaagaagacatagagaagctgttctttcttattgaaaatagcaaaaagcacgagaaatataagatcagggaatactatcataagattatcggccggaaaaacgataaggagaatttcgccaaaatcatttacgaagagatacagaacgtaaataacatcaaggagttgattgagaaaatccctgacatgtctgaactgaagaagtcccaggtgttttataaatactacctagacaaggaggaactcaatgataaaaacataaagtatgcattctgccactttgttgagattgaaatgtcacaactgcttaaaaattacgtctataagcgcctgagcaacatcagtaacgacaaaatcaagcgaattttcgagtaccagaatttgaagaaactcatcgaaaacaagctgttaaataaactggatacgtatgtgagaaactgtgggaagtacaattattacctccaggtgggagagattgccacctctgactttatagctaggaaccggcagaatgaagcattccttcgtaacatcattggcgtctccagcgttgcctacttctcgctgcgcaatatcttggagacagagaacgaaaatggtatcactgggagaatgaggggaaaaaccgtgaagaacaataagggcgaggaaaaatatgtatctggcgaggtggataagatttacaacgaaaataaacaaaacgaggtcaaggagaacctaaaaatgttttattcctacgacttcaatatggataacaagaatgaaatagaggactttttcgctaacatcgatgaagccatttcaagtatccggcatgggattgtgcactttaatctggagctcgaaggaaaggacatcttcgcgtttaaaaacatagcaccaagcgagatctccaagaaaatgttccagaatgagattaacgaaaagaaactgaaacttaagatctttaaacagttaaattctgccaacgttttcaattattacgagaaggatgtgattatcaaatatttgaagaacacaaaatttaatttcgtcaacaagaatataccgtttgtgcccagcttcaccaaactctacaacaagattgaagacctgcgaaacactttaaagttcttttggtcagtacctaaagacaaggaggagaaagatgctcagatctacctgctaaagaatatttattacggtgagttcctcaacaaatttgttaagaatagtaaggtgttctttaaaatcacaaacgaagtcataaagatcaataaacaacgcaaccagaagaccggccactataaataccagaagttcgaaaatattgagaagacggtgccagtcgaatatctggccatcattcaatccagagagatgatcaacaatcaggacaaagaggaaaagaacacttacatagattttattcagcagatcttccttaaagggtttatcgactatttgaataagaacaatctgaaatacattgagagcaacaataacaatgataacaacgacatcttctctaagattaagatcaaaaaggataataaagaaaagtacgacaaaatactcaagaactatgagaagcataataggaacaaagaaattccccacgagatcaatgagtttgtgcgggaaattaagctgggaaaaatccttaagtacaccgagaacctgaatatgttctatttgatactcaaactgttaaaccataaggaactgacaaatctaaaaggctcactcgagaagtaccaaagtgcaaacaaggaagagacttttagcgatgagctggaacttatcaatttgctgaacctcgacaataaccgcgttaccgaggatttcgaactggaggctaatgagattggtaaattcttagactttaacgaaaacaagatcaaagatagaaaggagctgaaaaagttcgacacaaataagatttattttgacggggaaaacatcataaaacacagggccttctacaatattaagaaatatggaatgcttaacttgctcgagaagatcgcggataaagccaagtacaagatctccctgaaagaactaaaggagtactctaataaaaagaacgagattgagaaaaattataccatgcagcagaacctgcaccgtaagtacgcacggcctaagaaagacgaaaagtttaatgatgaagactataaagagtacgaaaaggctataggcaacatccagaaatatacgcatctcaagaataaagtggagttcaacgagctgaatcttttgcaaggcctgttactcaagattctgcaccgacttgtagggtacacttcgatctgggaaagagatctgaggtttcgcttgaagggagagttcccagaaaaccattatattgaggaaatctttaatttcgacaacagcaaaaacgtcaagtacaaatccggtcagatagtggagaagtacatcaatttttataaagagctctacaaggataacgttgaaaagcggtcaatttatagtgacaaaaaggtgaaaaagctgaaacaggagaagaaggatctatacatcagaaattatattgcccacttcaactacatcccccatgctgaaatatctctgctcgaggtcctggagaatcttaggaaattgctgagctatgaccgcaagctgaaaaacgccattatgaagtccatcgtggatatcctcaaagaatacggcttcgtagcaacatttaagattggggccgacaagaaaatcgagatacagaccctggaatcagagaagattgtgcaccttaaaaatctgaagaaaaagaaactaatgactgatcgaaacagcgaggaactctgcgagctggttaaggtcatgttcgaatacaaggctttggagtga

SEQ ID NO: 11268 - RNA, 3459 nt, synthetic construct
  misc_feature 1..3459: note = Cas13a variant__Leptotrichia wadei__WP_021746774.1__Cas13a(G403D)
  source 1..3459: mol_type = other RNA
atgaaggtgaccaaagtcgacggcatcagccacaagaaatacattgaggaagggaagctggttaaatccacatctgaggaaaacagaacttcagagaggctcagtgaacttctgagcatacggttggatatctatattaagaatcccgacaacgcctccgaggaggaaaatcgcatccgacgtgagaacttaaagaaattcttttctaataaggtgctgcatctaaaagattcggtactctacctgaagaacagaaaagaaaagaatgctgtgcaggacaagaactattcagaggaggatattagcgaatacgaccttaaaaataagaacagtttctccgtcctgaaaaagatcttgctcaatgaggatgtgaactctgaggaactggaaatatttaggaaagacgttgaggcaaagctgaataaaatcaacagcctcaagtattccttcgaggaaaataaggccaactaccaaaagattaacgagaataacgtggaaaaggtcggaggtaaatcaaagcggaatatcatttatgattactaccgcgagagtgcgaaaagaaacgactatatcaataacgtgcaggaggcttttgataagttatacaagaaagaagacatagagaagctgttctttcttattgaaaatagcaaaaagcacgagaaatataagatcagggaatactatcataagattatcggccggaaaaacgataaggagaatttcgccaaaatcatttacgaagagatacagaacgtaaataacatcaaggagttgattgagaaaatccctgacatgtctgaactgaagaagtcccaggtgttttataaatactacctagacaaggaggaactcaatgataaaaacataaagtatgcattctgccactttgttgagattgaaatgtcacaactgcttaaaaattacgtctataagcgcctgagcaacatcagtaacgacaaaatcaagcgaattttcgagtaccagaatttgaagaaactcatcgaaaacaagctgttaaataaactggatacgtatgtgagaaactgtgggaagtacaattattacctccaggtgggagagattgccacctctgactttatagctaggaaccggcagaatgaagcattccttcgtaacatcattggcgtctccagcgttgcctacttctcgctgcgcaatatcttggagacagagaacgaaaatgatatcactggtagaatgagggggaaaaccgtgaagaacaataagggagaggaaaaatatgtatctggcgaggtggacaagatttacaacgaaaataaacaaaacgaggtcaaggagaacctaaaaatgttttattcctacgatttcaatatggacaacaagaatgaaatagaggactttttcgctaacatcgatgaagccatttcaagtatccggcatggcattgtgcactttaatctggagctcgaagggaaggatatcttcgcgtttaaaaacatagcaccaagcgagatctccaagaaaatgttccagaatgagattaacgaaaagaaactgaaacttaagatctttaaacagttaaattctgccaacgttttcaattattacgagaaggacgtgattatcaaatatttgaagaacacaaaatttaatttcgtcaacaagaatataccgtttgtgcccagcttcaccaaactctacaacaagattgaagacctgcgaaacactttaaagttcttttggtcagtacctaaagataaggaggagaaagacgctcagatctacctgctaaagaatatttattacggagagttcctcaacaaatttgttaagaatagtaaggtgttctttaaaatcacaaacgaagtcataaagatcaataaacaacgcaaccagaagaccggtcactataaataccagaagttcgaaaatattgagaagacggtgccagtcgaatatctggccatcattcaatccagagagatgatcaacaatcaggataaagaggaaaagaacacttacatagactttattcagcagatcttccttaaaggctttatcgattatttgaataagaacaatctgaaatacattgagagcaacaataacaatgacaacaacgatatcttctctaagattaagatcaaaaaggacaataaagaaaagtacgataaaatactcaagaactatgagaagcataataggaacaaagaaattccccacgagatcaatgagtttgtgcgggaaattaagctggggaaaatccttaagtacaccgagaacctgaatatgttctatttgatactcaaactgttaaaccataaggaactgacaaatctaaaaggatcactcgagaagtaccaaagtgcaaacaaggaagagacttttagcgacgagctggaacttatcaatttgctgaacctcgataataaccgcgttaccgaggacttcgaactggaggctaatgagattggcaaattcttagattttaacgaaaacaagatcaaagacagaaaggagctgaaaaagttcgacacaaataagatttattttgatggtgaaaacatcataaaacacagggccttctacaatattaagaaatatgggatgcttaacttgctcgagaagatcgcggacaaagccaagtacaagatctccctgaaagaactaaaggagtactctaataaaaagaacgagattgagaaaaattataccatgcagcagaacctgcaccgtaagtacgcacggcctaagaaagatgaaaagtttaatgacgaagattataaagagtacgaaaaggctataggaaacatccagaaatatacgcatctcaagaataaagtggagttcaacgagctgaatcttttgcaaggcctgttactcaagattctgcaccgacttgtaggctacacttcgatctgggaaagagacctgaggtttcgcttgaagggggagttcccagaaaaccattatattgaggaaatctttaatttcgataacagcaaaaacgtcaagtacaaatccggacagatagtggagaagtacatcaatttttataaagagctctacaaggacaacgttgaaaagcggtcaatttatagtgataaaaaggtgaaaaagctgaaacaggagaagaaggacctatacatcagaaattatattgcccacttcaactacatcccccatgctgaaatatctctgctcgaggtcctggagaatcttaggaaattgctgagctatgatcgcaagctgaaaaacgccattatgaagtccatcgtggacatcctcaaagaatacggtttcgtagcaacatttaagattggcgccgataagaaaatcgagatacagaccctggaatcagagaagattgtgcaccttaaaaatctgaagaaaaagaaactaatgactgaccgaaacagcgaggaactctgcgagctggttaaggtcatgttcgaatacaaggctttggagtga

SEQ ID NO: 11269 - RNA, 3909 nt, synthetic construct
  misc_feature 1..3909: note = Cas13a variant__Leptotrichia wadei__WP_021746774.1__6xHis-Tag/Twin-Strep/SUMO_Cas13a(G40 3D)
  source 1..3909: mol_type = other RNA
atgggcagctcccaccatcaccatcaccattcttcagggctggtgcccagaggaagtcacatggccagctggtcccaccctcagttcgagaagggtggcgggtctggaggcggttcagggggatcggcttggagccatccacaatttgaaaagatgagtgactccgaggtcaaccaggaagcaaagccggaggttaaacccgaagtgaagcctgagacccacatcaatctcaaagtatctgatggcagctccgagattttctttaagataaagaaaacaactccacttaggcggctgatggaagccttcgcgaagcgccagggcaaagagatggactcattgcgatttttatacgatgggatccgtattcaggctgaccaaacgcccgaagatctggacatggaggataacgacatcattgaggcccatagagaacagatcggaggtagtatgaaggtgaccaaagtcgatggcataagccacaagaagtatatcgaggaagggaagctagtgaagtctacatccgaggaaaataggacttcagagcggctcagcgagctgcttagtattcgcctggacatctacattaaaaaccctgataatgcatctgaagaggaaaacagaatcaggcgggagaatttgaagaaattcttttccaacaaggttctccacctgaaagacagcgtgctgtatctcaagaatcgcaaggaaaagaacgccgtccaggataagaattactcggaggaggacatatctgaatatgacctgaaaaacaaaaattccttctcagtgctgaaaaagattcttttgaacgaggatgtaaatagtgaggaactggaaatctttcgaaaggacgttgaggctaaactaaacaagattaacagcctcaaatactccttcgaggaaaataaggcaaactatcagaaaatcaatgagaacaatgtggaaaaggtcggaggcaagtctaaaagaaacatcatttacgattactatagggagagcgccaagcggaatgactacataaacaatgtgcaagaggcttttgataaactgtataagaaagaagacatcgagaaacttttctttctgattgaaaactcaaagaaacatgagaagtacaaaatccgtgaatattaccacaagataattggtcgcaaaaatgataaggagaacttcgccaaaatcatctatgaggaaattcagaatgtgaacaatatcaaggagttgattgaaaagataccagacatgagtgagctcaaaaagtcccaggtcttctacaaatactatctggataaggaagagttaaacgacaaaaacatcaagtacgcgttttgccatttcgttgagattgaaatgagccagctgctcaagaattatgtgtacaaaagactttctaacatctcaaatgataagatcaaaaggatttttgagtatcaaaacctgaagaaattgatagaaaataagctactgaacaagctcgacacctacgtacggaattgtgggaaatataactactacttacaggtgggagagatcgcaacaagtgacttcattgcccgaaatcgccagaacgaggcttttcttagaaatatcattggcgtcagctccgtggcctatttctctctgaggaacatcttggaaaccgagaatgaaaacgatataactggccggatgcgcgggaagacagttaaaaataacaagggagaggaaaaatacgtgtcgggtgaggtcgacaagatctataacgagaataagcaaaacgaagtgaaagagaatctcaagatgttttacagctatgatttcaacatggacaataaaaacgaaattgaggactttttcgcaaatatcgatgaagctatttcctcaatcagacacggcatagtacattttaacctggagttagaggggaaggatattttcgcctttaaaaatatcgcgcccagtgaaatttctaagaaaatgttccagaacgagatcaatgaaaagaagctgaaactaaagatattcaaacagctcaacagcgccaatgtttttaactactatgagaaggacgtgatcattaaatacctgaagaataccaagttcaactttgtcaacaaaaatatccctttcgtgccatcctttacgaaactttacaacaaaattgaagatttgaggaatactctgaagttcttttggtcagtcccgaaagacaaggaggagaaggatgcacagatctatctcctgaaaaacatatactatggagagttccttaataagtttgtgaaaaacagcaaggttttctttaaaattaccaatgaagtgatcaagatcaacaagcaacgtaatcagaaaacaggccactacaagtatcagaaattcgaaaacattgagaagactgtacccgtcgaatacctggctatcattcagtctcgggagatgataaataaccaagacaaagaggaaaagaatacctatatcgattttattcagcagatcttcttgaagggtttcattgactacctcaacaaaaataacctgaagtacatcgagtccaataacaacaatgacaacaatgatatatttagtaaaatcaagattaaaaaggacaacaaagaaaagtatgataagatcctgaaaaattacgagaagcacaaccgaaataaagagattcctcatgaaatcaacgagttcgtgagagaaataaagttagggaaaattctaaagtatacagagaatctcaacatgttttacctgatccttaagttgctgaatcacaaagaactcaccaacctgaagggcagcttagagaaatatcagtctgccaataaggaggaaacgttctccgacgagctggaacttatcaacttgctcaatctggataacaacagggttactgaggactttgaactagaggctaatgagattggaaaattcctggattttaacgaaaataagataaaggaccgcaaagagctcaagaaattcgatacaaacaagatctactttgacggcgaaaatattatcaaacatcgggccttctataacattaagaagtacgggatgctgaatcttttggagaaaatcgcagataaggccaaatacaagatatcactgaaagaattaaaggagtatagtaacaaaaagaatgagatcgaaaagaactacaccatgcaacagaatctccacagaaaatatgctaggccaaagaaagacgagaagtttaacgatgaagactacaaagagtatgagaaggcgattggaaatatccagaagtacactcacctgaaaaacaaggtggagttcaatgaacttaacctgttgcagggtctcctgctaaaaattctgcatcgcctcgtcggctatacaagcatctgggaacgagacctgcggttccgtcttaagggggagtttcccgaaaaccactacatagaggagattttcaattttgataactcgaaaaatgtgaagtacaagtccggacaaatcgtagaaaaatatatcaacttctacaaggagttgtataaagacaatgtggaaaagagatctatttacagcgataaaaaggttaagaaactgaagcaggagaaaaaggacttatatatcaggaactacatagcacattttaattatattcctcacgccgaaatctcactcctggaggtccttgagaacctgcgcaaactactcagttacgatcggaagctgaaaaatgctattatgaagtccatcgtggacatattgaaggaatacggcttcgtggccacctttaaaattggtgcagataagaaaatcgagatccagacgctggaatctgagaagattgtccatctcaaaaacttaaagaagaaaaagctgatgaccgacagaaatagcgaggaactttgcgagctggttaaagtgatgttcgaatataaggccttggagtga

SEQ ID NO: 11270 - RNA, 3459 nt, synthetic construct
  misc_feature 1..3459: note = Cas13a variant__Leptotrichia wadei__WP_021746774.1__Cas13a(R474A,R1046A)
  source 1..3459: mol_type = other RNA
atgaaggtgaccaaagtcgacggcatcagccacaagaaatacattgaggaagggaagctggttaaatccacatctgaggaaaacagaacttcagagaggctcagtgaacttctgagcatacggttggatatctatattaagaatcccgacaacgcctccgaggaggaaaatcgcatccgacgtgagaacttaaagaaattcttttctaataaggtgctgcatctaaaagattcggtactctacctgaagaacagaaaagaaaagaatgctgtgcaggacaagaactattcagaggaggatattagcgaatacgaccttaaaaataagaacagtttctccgtcctgaaaaagatcttgctcaatgaggatgtgaactctgaggaactggaaatatttaggaaagacgttgaggcaaagctgaataaaatcaacagcctcaagtattccttcgaggaaaataaggccaactaccaaaagattaacgagaataacgtggaaaaggtcggaggtaaatcaaagcggaatatcatttatgattactaccgcgagagtgcgaaaagaaacgactatatcaataacgtgcaggaggcttttgataagttatacaagaaagaagacatagagaagctgttctttcttattgaaaatagcaaaaagcacgagaaatataagatcagggaatactatcataagattatcggccggaaaaacgataaggagaatttcgccaaaatcatttacgaagagatacagaacgtaaataacatcaaggagttgattgagaaaatccctgacatgtctgaactgaagaagtcccaggtgttttataaatactacctagacaaggaggaactcaatgataaaaacataaagtatgcattctgccactttgttgagattgaaatgtcacaactgcttaaaaattacgtctataagcgcctgagcaacatcagtaacgacaaaatcaagcgaattttcgagtaccagaatttgaagaaactcatcgaaaacaagctgttaaataaactggatacgtatgtgagaaactgtgggaagtacaattattacctccaggtgggagagattgccacctctgactttatagctaggaaccggcagaatgaagcattccttcgtaacatcattggcgtctccagcgttgcctacttctcgctgcgcaatatcttggagacagagaacgaaaatggtatcactgggagaatgaggggaaaaaccgtgaagaacaataagggcgaggaaaaatatgtatctggcgaggtggataagatttacaacgaaaataaacaaaacgaggtcaaggagaacctaaaaatgttttattcctacgacttcaatatggataacaagaatgaaatagaggactttttcgctaacatcgatgaagccatttcaagtatcgcgcatgggattgtgcactttaatctggagctcgaaggaaaggacatcttcgcatttaaaaacatagccccaagcgagatctccaagaaaatgttccagaatgagattaacgaaaagaaactgaaacttaagatctttaaacagttaaattctgctaacgttttcaattattacgagaaggatgtgattatcaaatatttgaagaacacaaaatttaatttcgtcaacaagaatataccgtttgtgcccagcttcaccaaactctacaacaagattgaagacctgcggaacactttaaagttcttttggtcagtacctaaagacaaggaggagaaagatgcccagatctacctgctaaagaatatttattacggtgagttcctcaacaaatttgttaagaatagtaaggtgttctttaaaatcacaaacgaagtcataaagatcaataaacaacgaaaccagaagaccggccactataaataccagaagttcgaaaatattgagaagacggtgccagtcgaatatctggcaatcattcaatcccgcgagatgatcaacaatcaggacaaagaggaaaagaacacttacatagattttattcagcagatcttccttaaagggtttatcgactatttgaataagaacaatctgaaatacattgagagcaacaataacaatgataacaacgacatcttctctaagattaagatcaaaaaggataataaagaaaagtacgacaaaatactcaagaactatgagaagcataatagaaacaaagaaattccccacgagatcaatgagtttgtgagggaaattaagctgggaaaaatccttaagtacaccgagaacctgaatatgttctatttgatactcaaactgttaaaccataaggaactgacaaatctaaaaggctcactcgagaagtaccaaagtgctaacaaggaagagacttttagcgatgagctggaacttatcaatttgctgaacctcgacaataaccgggttaccgaggatttcgaactggaggccaatgagattggtaaattcttagactttaacgaaaacaagatcaaagatcgcaaggagctgaaaaagttcgacacaaataagatttattttgacggggaaaacatcataaaacacagagcgttctacaatattaagaaatatggaatgcttaacttgctcgagaagatcgccgataaagcaaagtacaagatctccctgaaagaactaaaggagtactctaataaaaagaacgagattgagaaaaattataccatgcagcagaacctgcacaggaagtacgctcgtcctaagaaagacgaaaagtttaatgatgaagactataaagagtacgaaaaggccataggcaacatccagaaatatacgcatctcaagaataaagtggagttcaacgagctgaatcttttgcaaggcctgttactcaagattctgcaccggcttgtagggtacacttcgatctgggaacgagatctgagatttaggttgaagggagagttcccagaaaaccattatattgaggaaatctttaatttcgacaacagcaaaaacgtcaagtacaaatccggtcagatagtggagaagtacatcaatttttataaagagctctacaaggataacgttgaaaagcgctcaatttatagtgacaaaaaggtgaaaaagctgaaacaggagaagaaggatctatacatcgctaattatattgcccacttcaactacatcccccatgcagaaatatctctgctcgaggtcctggagaatcttcggaaattgctgagctatgacagaaagctgaaaaacgccattatgaagtccatcgtggatatcctcaaagaatacggcttcgtagctacatttaagattggggcggacaagaaaatcgagatacagaccctggaatcagagaagattgtgcaccttaaaaatctgaagaaaaagaaactaatgactgataggaacagcgaggaactctgcgagctggttaaggtcatgttcgaatacaaggcattggagtga

SEQ ID NO: 11271 - RNA, 5073 nt, synthetic construct
  misc_feature 1..5073: note = Cas13a variant__Leptotrichia wadei__WP_021746774.1__XY_Cas13a(R474A,R1046A)_EGFP_ZF-CCR5 T_KRAB -A _NLS
  source 1..5073: mol_type = other RNA
atgggcggggagggactgagagccagccccaggcggcgccctctccttccactgcagccgcgaggttgcccccgtggcgacgggtgtttgagaggaggcaggggtcgggctgggttcggattttggcgcgtgaccggcggctccagagcatctgccaaccacgtccatgcgttctttttctttttacaactgctagggaatgttctcgtgatcgtactgtcacaccatttcggaaaggaatttggtacagctggccctggggccactatgaaagtgacgaaggtcgatggaattagtcacaaaaagtacatagaggaaggcaaacttgttaagagcacctccgaggaaaacaggacatctgagcggctgtcggagttgctctcaatccgcctggacatttatatcaagaatccagataacgcaagcgaagaggaaaatcgaattagaagggagaacctgaaaaagttctttagtaataaagtgctccatttaaaggactccgtgctgtaccttaaaaaccggaaggagaagaatgccgtccaggataaaaactattctgaagaggacatcagcgaatacgatttgaagaataaaaactccttctcagtgctgaagaaaatactactcaatgaggacgtaaacagtgaggaactggagatctttcgtaaggatgttgaagctaaacttaataagattaacagcctgaagtattctttcgaggaaaacaaagcaaattaccagaagatcaacgagaataacgtggaaaaagtcggtgggaagtccaaacgcaatattatctatgactactacagagagtcagccaagaggaacgattatataaataacgtgcaggaggcttttgacaagttgtacaaaaaggaagatattgagaaactcttcttcctgatcgaaaatagcaagaaacacgagaagtataagattcgggaatactatcacaaaatcatcggacgaaagaacgacaaagagaattttgccaagattatatacgaggaaatccaaaacgtgaataacattaaagagttaatcgaaaagatacccgacatgagtgagctgaagaaatctcaggtcttctataagtactacctcgataaagaggaacttaatgacaagaacattaaatatgcgttttgccatttcgttgagatcgaaatgtcccagctgttgaagaactacgtgtataaacgcctaagcaatatctcgaacgataagattaagagaatctttgagtaccagaatctgaaaaagctcattgaaaacaaactgcttaataagctggacacttatgtaaggaactgtggcaaatacaattattacttgcaagtgggcgagatagcaacctctgatttcatcgcccggaaccgccagaatgaggcttttctcagaaacattatcggggtctcctcagtggcctacttcagtctgaggaatatcttagaaacagagaacgaaaatggaattaccggtcgtatgcggggcaagactgttaagaacaataaaggggaggaaaagtatgtgagcggagaggtcgacaaaatatacaacgagaacaagcagaatgaagtgaaagagaacctgaagatgttttattcctacgatttcaatatggacaacaagaatgaaatcgaggactttttcgcaaacattgatgaagctatctctagcattgcccacggcatcgtacattttaatctagagctcgagggtaaagatatattcgcgttcaagaacatcgccccttcagaaattagtaaaaagatgtttcagaatgagatcaacgaaaagaagctgaagttgaaaattttcaagcaacttaattccgcaaacgtttttaattattacgagaaagacgtgatcataaagtatctgaaaaacacaaagttcaattttgtcaacaaaaacattccattcgtgcccagctttaccaagctctacaataagatcgaggacctgcgaaacacgcttaaattcttttggtctgtccctaaggataaagaagagaaggacgctcagatttacctgttgaaaaatatctattacggggagttcctcaacaagtttgtgaaaaattcaaaagttttctttaagataactaacgaagtgatcaaaattaataagcagagaaaccagaaaaccggccactataagtaccaaaagttcgaaaatatcgagaaaacagtaccagtcgagtatctggccattatccagagtagggaaatgataaacaatcaggataaggaggagaaaaacacttacattgacttcatccaacagatctttttaaagggattcattgattatctgaataaaaacaatctaaagtacatcgaaagcaacaataacaacgacaataacgatatattttccaagattaaaatcaagaaagacaataaggaaaaatacgataagattctcaagaactatgagaaacacaatcgcaacaaggagatcccgcatgaaattaatgagttcgtgcgggaaatcaaactgggcaagatacttaaatacaccgagaacttgaatatgttttatctgatcctcaagctgttaaaccacaaagaactgacaaatcttaaggggtctttggagaagtaccagtcggctaacaaagaggaaaccttcagcgacgagctcgaactgattaatctactgaacctcgataataacagagttacggaggactttgagctggaagccaacgagatcggaaagttccttgattttaatgaaaacaaaattaaggacaggaaagagttgaagaagttcgacactaataaaatctattttgatggtgaaaacataattaagcatcgcgcattctacaatatcaaaaagtatggcatgctgaacttactcgagaaaatcgccgacaaggctaagtacaaaatttccctgaaggagcttaaagaatactcaaataagaaaaacgagatagaaaagaattatacaatgcagcaaaacctgcaccgaaagtacgcgcggcccaaaaaggatgagaaattcaatgacgaagattataaggagtacgagaaagcaatcgggaacattcagaagtatacccatttgaaaaataaggtggaatttaacgagctcaatctgctacagggactgctcctgaagatccttcaccgtttggtcggctacacaagtatttgggaaagagacctgaggttccgcttaaaaggtgagtttcctgaaaaccactatatcgaggagatattcaactttgataattctaagaacgtgaaatacaagagcgggcagatcgtagaaaaatacattaatttctataaggagctctacaaggacaacgtggaaaaacggtccatctattcagataagaaagttaagaaactgaagcaagagaagaaagacctttacattgccaattatatcgctcattttaactacataccacacgccgagattagcctgctagaagtcctcgagaatctgagaaagttgctgtcttatgataggaaattaaagaacgcaatcatgaaatccatcgtggacattctcaaggaatacggcttcgtggccacttttaagatcggagctgataaaaagatagagattcagaccctggaaagtgagaaaatcgtccatcttaagaatctgaaaaagaaaaagttgatgacggaccgaaacagcgaggaactctgcgagctggttaaggtgatgttcgaatacaaagccctagagggcgggggaggttctggcgggggaggctccggtgggggcggatcagtgagtaagggcgaggaactgtttaccggggtagtccccattcttgtggagctcgacggagatgttaatggccacaaattcagcgtgtcgggtgaaggggagggagacgcaacatatggcaagctgactttgaaatttatctgtaccacaggtaagctgcctgtcccatggcccactttagtgaccacactcacctacggcgttcagtgcttctcccgctatccggatcacatgaagcagcatgacttctttaaatctgcgatgcctgaagggtacgtgcaagagcggactatattctttaaggatgacggaaactataaaacgagagctgaagtaaagttcgagggcgatacactggtcaataggattgagcttaaagggatcgactttaaggaagatggaaacatcctgggccacaagttggagtacaattataacagccataacgtgtacattatggccgacaaacagaagaatggtatcaaagtgaacttcaagattcgtcacaatatagaagatgggtcagtccagctcgcagaccattaccaacagaacacccccatcggagacggcccagttctgctacctgataatcactatctgagtactcagtccgccctttctaaagaccccaacgagaagcgcgatcacatggtgctcctggagtttgtaaccgctgccggtattacattgggcatggacgaattatacagcagaggggcaggagctggcgccggggcgggagccggctcccggttccagtgtaggatctgcatgcgaaatttttcagatcggagcaacctgagtcgccatatcagaacccacactggtgagaagccattcgcttgtgacatttgcgggaggaaatttgcaatatcttccaatctcaacagccatacaaagatccacacgggatcgcaaaaacccttccagtgtcggatttgcatgcgaaatttttcaagatctgataacctggcccgccatatcaggacccacactggcgaaaagcctttcgcttgcgacatttgtggtcgtaaattcgccacaagtggcaatcttacccggcacacaaagatccatctgagagggtcccagttgagcatagtggatgcaccagagcagagggaaggagcgtctcaagtcagcgtgtccgttacttttgaggacgtggccgtcctattcacccgcgatgagtggaagaaactggacctctcacagcgaagtctgtatagagaagtgatgcttgagaactacagcaatttagcttctatggccggctccccgaagaaaaagcggaaagtttga

SEQ ID NO: 11272 - RNA, 3549 nt, synthetic construct
  misc_feature 1..3549: note = Cas13a variant__Leptotrichia wadei__ERK53440.1__Cas13a
  source 1..3549: mol_type = other RNA
atgtacatgaagatcaccaaaattgacggcgtgagccactataagaaacaggataaggggatactgaaaaagaagtggaaagacctcgatgagagaaagcaaagggaaaagatcgaggcccggtacaacaagcagattgaatccaaaatctataaggagttctttcgccttaagaataaaaagcgaattgaaaaagaggaggaccagaacatcaagtctctgtacttctttataaaagaattgtatttaaatgagaagaacgaagagtgggagctgaaaaatatcaacctagaaattctcgatgacaaggagcgtgtcatcaagggatacaaattcaaggaagatgtttactttttcaaagagggttataaggaatactatctgaggattctttttaataacctgatcgagaaagtgcagaatgagaacagggaaaaggtacggaagaataaagagttcttggacctcaaggaaatatttaaaaagtacaaaaaccgcaagattgatctgctgctcaagtcaatcaataacaataaaattaacttagagtataagaaagaaaacgtgaatgaggagatctacggcatcaaccccacaaatgacagagaaatgactttctatgagctgcttaaggaaattatagagaaaaaggatgaacaaaagagtatcttggaggagaaactggacaactttgatattacgaatttcctagaaaacatcgagaagatatttaatgaagagaccgagattaacatcatcaaagggaaggtcctcaatgaactgagggagtacattaaagaaaaggaggaaaacaatagcgacaacaaacttaagcagatctataatctggagttgaagaaatacattgagaacaatttctcctacaagaaacagaagtctaaatcgaagaacggaaagaacgactatctctacctgaatttcctgaaaaagataatgtttatcgaagaggtggatgagaaaaaggaaattaacaaagaaaagttcaagaataaaatcaactcaaattttaagaacttattcgttcagcatatcctcgactatggcaaacttctgtactataaggagaatgatgagtacattaaaaacacaggtcaattggaaactaaggacctagagtatataaagaccaaagaaacactgatccggaagatggctgtgctcgtcagctttgcagccaatagttactacaacctgttcgggcgcgtgtccggagatattcttggcaccgaggtagttaaatctagcaagactaatgtgatcaaagtcggctcccacatttttaaggagaaaatgctgaactatttctttgacttcgaaatctttgatgcgaataagatagtggagatcttggaatcaattagttacagcatctataacgtgcgaaatggggtcggacatttcaacaagctcattctgggtaaatacaagaaaaaggacatcaacacaaataaaagaatagaggaagatttaaacaataacgaggagattaagggctattttatcaagaaaagaggggaaattgagcggaaggttaaagaaaagttcctgtctaataacctacagtactattactccaaagagaagatcgaaaattacttcgaggtgtatgagtttgaaatactcaagcgtaaaatccctttcgctccaaactttaagcgcattatcaaaaagggagaggacctgttcaataacaaaaataacaagaagtacgaatattttaaaaatttcgataagaactcagccgaggagaaaaaggaatttcttaaaaccagaaatttcttgctgaaggagctctactataacaacttttacaaggagttcctgagcaaaaaggaagaatttgagaaaattgtacttgaagtgaaggaggagaaaaagagtaggggcaatatcaacaataaaaagtctggtgtctccttccagagcatagacgactatgatacgaagattaacatctcggactacatcgcatctattcacaaaaaggaaatggagcgggtggaaaaatacaatgaggagaagcagaaagatactgccaagtatatccgagactttgttgaagagattttcctgaccgggttcataaactacttggaaaaggataaacgcctccattttctgaaggaggagttctccatcttatgcaataacaataacaatgtggtcgactttaacattaatatcaacgaagagaaaattaaggagttcctgaaagaaaatgattcaaagacactaaacctctatctgtttttcaatatgatcgacagtaagagaataagcgaatttaggaacgagcttgtgaaatacaagcaattcactaaaaagcggttggatgaagagaaagagtttctgggaatcaagattgaactctatgagaccctgatcgagttcgtaattttaacacgcgaaaagctggacaccaaaaagtccgaagagatcgatgcttggcttgttgacaaattgtacgtgaaggattctaacgagtataaagaatacgaggaaatactcaagctgtttgtcgacgagaaaattctaagctcaaaggaggcaccgtactatgccacggacaataagactcccatcctgctcagtaacttcgagaaaacaagaaagtacggcacccagtccttcctgagcgaaatccagtctaattataaatactcaaaggtggaaaaagagaacattgaagattataataagaaggaggagatagaacagaaaaagaaaagtaacatcgagaaacttcaagacttgaaagtcgaactgcacaagaagtgggagcagaataaaattactgaaaaggagatcgagaaatacaacaatacaaccaggaagattaacgaatataattacctcaaaaacaaggaggaattacagaatgtgtacctgcttcacgagatgctgagcgatttgctcgctcgtaacgttgcctttttcaataagtgggaacgggactttaaattcatcgtgatagcgatcaagcaatttctgcgagagaacgataaagagaaggtaaacgagttcctaaatcctccagacaactccaaaggcaagaaagtctatttttctgtgtcgaagtacaagaatacggttgaaaacattgatgggatccataaaaatttcatgaacctgatttttctcaataacaagttcatgaatagaaaaatcgacaagatgaactgtgcaatatgggtgtattttaggaattacattgcccacttcctgcatcttcacaccaaaaacgaaaagatcagcttgatctcccagatgaatctgttaattaagctcttttcatatgataaaaaggtccagaaccacatcctgaaaagtacaaagactcttctggagaaatacaatatacagattaacttcgagatctctaacgacaagaatgaagtgttcaagtataaaattaagaaccgcctatacagcaaaaagggaaaaatgctcggtaagaataacaagtttgagatcctggaaaatgagttcttggaaaacgtaaaagctatgctggagtactccgagtga

SEQ ID NO: 11273 - RNA, 4158 nt, synthetic construct
  misc_feature 1..4158: note = Cas13a variant__Clostridium aminophilum__WP_031473346.1__Cas13a
  source 1..4158: mol_type = other RNA
atgaagttcagcaaagtggaccacaccagatccgccgtcggcatccagaaggctacagattctgttcatgggatgctgtacactgaccccaaaaagcaagaagtgaacgatctcgacaaaaggtttgatcagcttaatgtaaaggcaaagcggctgtataacgtgttcaatcagtcaaaagccgaagaggacgatgacgaaaagcgctttggaaaagtcgtgaagaaattgaaccgagagttaaaggatctgctattccaccgtgaagttagtagatacaatagcattggtaacgcgaagtataattactatggcataaaatccaaccctgaggagatcgtgtctaatctcgggatggtcgaatcgctgaagggagagagggacccacagaaagtgatttcaaaacttctgttgtactatctccggaaaggcctgaagccgggtacggatgggctgcgcatgatcctcgaagctagctgcggattaagaaaactgagtggcgacgagaaggagcttaaggtatttttgcaaaccctggatgaagacttcgagaaaaagacatttaaaaagaacctaattaggtccatcgaaaatcagaacatggccgttcagccctctaatgagggcgaccctataatcgggattactcagggacggttcaacagccaaaagaatgaagagaagtccgcaatcgagcgcatgatgtcaatgtacgccgatctcaacgaagaccatcgagaggatgtgctgagaaaacttaggcggctgaacgtcttgtactttaatgtggacaccgaaaagacagaggaaccaaccctccccggtgaggtggatactaaccctgtcttcgaggtttggcacgaccatgaaaagggcaaagagaatgatcgtcagtttgctacattcgcaaagattctgaccgaagaccgcgagacgaggaaaaaggaaaagttagccgtgaaagaggctctgaacgatctcaagagtgccatcagagaccacaatataatggcgtatcggtgtagcattaaagtaactgagcaggataaggacgggctgtttttcgaagaccagcgaatcaaccgcttctggattcaccatatcgagtctgcagtggaaagaatccttgcctccattaatccagagaaattgtacaagctaaggataggatatctgggcgagaaggtctggaaagatctcctgaactacctttcaatcaagtatattgctgtgggtaaagccgtttttcacttcgcaatggaagacctggggaagaccggacaagatatcgagttgggcaaactcagcaatagtgtgtctggcgggctgacatcctttgactacgaacagatacgggctgatgagactttacagcgccaactgagcgtcgaagtggccttcgcggccaacaatctatttagagcagtagttggacagaccggtaagaaaattgagcagtcgaagtctgaggaaaacgaggaagacttcctcctgtggaaggctgagaaaatcgccgaatccatcaagaaagagggcgaggggaatacacttaagtcaattttgcagtttttcggaggcgctagtagctgggatctgaaccatttttgcgccgcatatggtaatgaatcctctgccctcgggtacgagaccaaattcgctgacgatctgaggaaggcgatctacagccttcgtaacgaaacgtttcacttcactacactgaacaagggctcatttgactggaatgcaaaattgattggagatatgttcagtcacgaggccgctaccggcatagccgtggaacggactcgattctattccaacaatctccccatgttttacagagagagcgacctgaagaggatcatggatcatttatataacacataccaccctcgcgcatctcaagtcccatcattcaatagtgtgtttgtccggaaaaacttcagactgtttctaagcaataccctcaacacgaatacctccttcgacacagaggtgtatcagaagtgggaatctggggtttactatctgtttaaagagatttactacaactcgttccttccgagcggagacgcccatcacttgtttttcgaaggtctgaggcgcatccgaaaggaggctgataatctccccatcgtgggcaaggaggccaaaaagcggaacgcagtacaggactttgggcgtagatgtgatgaactgaaaaatttatccctgtcagcgatttgccagatgataatgactgagtataacgaacaaaataacggaaacaggaaggtcaaaagtacccgcgaggacaagcggaagcctgatatcttccagcattacaaaatgcttttgctcagaacactgcaggaggcttttgccatttatatcaggcgagaggagttcaagttcatttttgacctaccaaaaactctgtacgtgatgaagcccgttgaagagttcctccctaattggaaatctggcatgtttgatagcctggtggaacgcgtcaagcagtccccagaccttcaacggtggtatgtgttgtgtaaattcctgaacggtagattactcaatcagctgtcaggggtaatcaggagctacatacagtttgcaggcgatatccagcgtcgcgccaaggctaaccacaatcggctttatatggacaacacccaaagagtggagtactactctaatgttctggaagtcgtggatttctgcattaagggaacatccaggtttagtaacgtgttcagcgactattttcgagatgaggacgcctacgcagactatttggataattacctccagttcaaagacgagaagatcgctgaagtctcttcctttgccgcgctgaaaaccttctgtaacgaggaagaggttaaggccggcatttatatggatggggaaaatcccgtgatgcagcggaacatcgtgatggctaaactattcggaccggacgaggtactgaagaatgtcgtgcctaaggttactcgcgaggaaatagaggaatactatcaactcgagaaacagattgcaccctacagacagaacggttactgcaagtcagaggaagatcagaaaaagctgcttaggtttcaacggatcaaaaatcgagtggagttccagacgattacagaatttagtgagatcataaacgaattgctgggccagttaatcagctggtcgttcctcagagagcgcgacctgctttattttcagctggggttccactacctatgtctccataacgataccgagaagccagccgaatataaggagatttccagggaagacggaactgtcatccgtaatgctattctgcaccaagtggccgcaatgtacgttggcggtttgcctgtgtataccctggcggataaaaagttagccgcttttgagaaaggggaagccgactgcaagctctctatcagcaaagatacagcaggcgctggaaagaagataaaagacttctttcggtactcaaagtatgtactgattaaagacagaatgcttaccgatcagaaccagaagtacactatctacctggccggcttggaactcttcgagaatacagacgaacatgataacatcacggacgtcaggaaatatgtggatcactttaagtactatgcaaccagtgacgagaatgccatgtccattctggatctatactctgaaatccacgaccgcttctttacttatgatatgaagtaccagaaaaacgtggctaatatgctggagaacattcttctccgacatttcgtcctgataagacccgagttctttacagggagcaagaaagttggagaaggcaagaaaatcacctgtaaggcgcgggcccaaattgagatcgcagaaaatggtatgaggtccgaggacttcacatataaattgtcagatgggaagaagaacattagcacttgcatgatcgctgcccgcgaccagaaatacctgaataccgtggcccgtttactctactatccacacgaagctaagaaaagtatagtagatacgagagagaagaaaaacaataagaagaccaaccggggagacggcacatttaataaacagaagggtactgcaaggaaagagaaggacaacggcccccgcgagttcaatgataccgggttttctaacacacctttcgccggatttgacccattccgaaactcctga

SEQ ID NO: 11274 - RNA, 4035 nt, synthetic construct
  misc_feature 1..4035: note = Cas13a variant__Eubacterium rectale__CVRQ01000008.1__Cas13a
  source 1..4035: mol_type = other RNA
atgctgagaagggacaaggaggtgaaaaagctctacaacgtcttcaatcagatccaagttggcaccaaacccaagaaatggaacaatgatgaaaagttgagccctgaggaaaacgagcggcgcgcccagcagaagaatattaaaatgaagaactataaatggcgagaggcttgctccaagtacgtggaatcttcacagcgtataatcaatgacgtaattttctatagttacagaaaagcaaagaacaagctgaggtatatgcggaaaaatgaggatatcttgaagaaaatgcaagaagccgagaagttaagcaaattctccgggggaaagctggaagactttgtggcgtacacactacgcaaatctctcgtcgtgtcgaagtatgatactcaggagttcgactcactggctgccatggttgtgtttcttgagtgtattggtaagaacaatatcagcgatcacgaaagagagatagtctgcaaactgttggaactcatcaggaaggacttcagtaaactggatccaaacgtgaagggctcccagggggcaaatattgtacggtctgttcgcaaccagaatatgatcgtgcaaccgcagggagaccgatttctgttcccccaggtctacgccaaagagaacgaaacggtgaccaacaagaatgtggagaaggagggcctcaacgaatttttactgaattacgctaaccttgatgacgagaaaagagcagaaagccttaggaagctgcggcgtattctagatgtctatttctccgcccctaatcattacgagaaagacatggacatcacactctcagataacatagaaaaggagaaatttaatgtttgggagaagcacgaatgtggtaagaaagagactgggctgttcgtggacattccagatgtacttatggaagctgaggccgaaaacatcaagctggacgcggtggtcgagaaacgcgagagaaaggtgttgaatgatagggttcggaaacagaacattatctgctatcgatacacccgcgcagtggtcgaaaagtataatagtaacgagcccctctttttcgaaaataacgccatcaatcaatactggattcatcacatagagaacgctgtggagagaatcctgaagaactgtaaagccggaaagttattcaaactgaggaagggctatctcgcagaaaaagtatggaaggacgctattaatcttatcagcataaaatacattgccctgggcaaggcggtttacaactttgccttggatgacatctggaaggataaaaagaataaagagctagggatcgtggacgaacggattcgcaacggaatcacatctttcgattatgagatgattaaggcacatgaaaatctgcagagagagctcgctgtcgacatagccttttccgtgaacaatctggctagggccgtctgcgacatgtcaaaccttggtaataaagagagcgatttcctgttgtggaagcgtaacgacatcgcagataagctcaaaaataaggacgatatggccagtgtgtctgctgttctgcagtttttcggcgggaaatccagctgggacattaacatctttaaggatgcgtacaaaggaaagaagaaatataattacgaagtgcggttcatcgacgatttacgaaaggcaatttattgtgccagaaacgagaattttcacttcaaaaccgctctggtaaacgacgaaaagtggaacactgagctatttggcaaaatattcgaaagggagacagagttttgcctcaatgtcgaaaaggatcgcttctactcgaacaatctgtatatgttctaccaagtgtctgagcttcggaacatgttggaccacctgtactccagatcagttagtagggccgcacaggtgcctagctataattccgtcatcgtgcgcaccgcctttccagaatacattacgaacgtactcggttatcagaagccctcttacgatgctgacactctggggaaatggtatagcgcctgttactatcttctgaaggagatctactacaattcattcttgcagagtgaccgagcactccaactgtttgaaaaatccgtgaagaccttaagctgggatgacaaaaagcagcagcgggcggttgataacttcaaagaccatttttctgatattaagtcagcttgcacaagtctggcccaggtctgtcaaatctatatgactgagtacaatcagcagaacaatcagataaagaaagtgcgtagctccaacgactctatcttcgatcaacctgtgtatcagcactacaaggtcctactcaaaaaggcaattgccaatgcttttgccgactatctgaaaaacaataaggatcttttcggatttatcggcaagccattcaaagcaaacgagattagagaaatcgacaaggagcagtttttgccggattggacctcgaggaaatacgaagctctgtgcatagaggttagcggctcccaggagctccaaaagtggtatattgtggggaaattcctgaacgcccgctcattaaatctgatggtgggaagtatgcggtcttacatccagtacgtaacagacattaagagaagggcggccagcatcggtaacgaacttcatgtctccgtgcacgatgttgagaaggtggaaaaatgggtccaggtgatagaggtttgctcattgctcgctagccgaacctctaatcaatttgaagactatttcaacgacaaggatgactacgcacgctatctgaaatcctacgtggatttcagtaatgtagacatgcccagcgagtattctgccctagtcgatttttccaacgaggaacagtcagacctgtacgtggatcctaagaatccaaaagtgaaccggaatatcgtccacagtaagctctttgctgccgaccatattctgagagatatcgttgagcccgtgagcaaggacaacattgaagagttttattcgcagaaagcagaaatcgcgtactgtaagataaaaggcaaggagattacggccgaggaacagaaagctgtacttaagtaccaaaagttgaaaaatagggtggagctgcgtgatatcgtcgaatatggggagatcattaacgaattactcggacagctgatcaattggtccttcatgcgcgagcgggaccttctgtactttcagttgggcttccactatgactgcctcagaaacgattctaagaaacctgagggttacaagaatattaaagtggacgaaaacagcataaaggatgccatcctgtatcagattatcgggatgtacgttaatggcgtgactgtctatgcaccagagaaagacggagataagctaaaggaacaatgtgtgaaaggcggggttggagtgaaggtctcagcttttcataggtacagtaaatacctgggtctcaacgagaagacactgtataacgccggccttgagattttcgaagtagtggcagagcacgaagacatcataaatttgcgaaacgggatcgatcattttaaatactatctgggagactaccggtccatgttatctatttatagcgaggttttcgatcgctttttcacctacgacatcaagtatcagaagaatgtgctcaacctgcttcagaatattctgctaagacacaacgtcatcgtggaacccatactcgagtccggcttcaaaactattggtgagcagacaaagccgggggccaaactgtcaatcaggagcatcaagagtgatacctttcaatacaaagtaaagggcggaacgttgattaccgacgctaaggatgaacggtacctggagacaatacgaaaaatcttatattacgcggaaaatgaggaagacaacctcaagaaatctgtggtcgttactaatgccgacaagtatgagaaaaacaaggagtccgatgaccagaataagcagaaagaaaagaaaaacaaggataataaaggcaagaaaaacgaggaaaccaagagcgacgcagagaagaataacaacgaaagactgtcgtacaatcctttcgctaaccttaattttaaactgtcaaactga

SEQ ID NO: 11275 - RNA, 3858 nt, synthetic construct
  misc_feature 1..3858: note = Cas13a variant__Herbinix hemicellulosilytica__CRZ35554.1__Cas13a
  source 1..3858: mol_type = other RNA
atgaagctgaccagaaggcggatcagcggcaactccgtggaccagaaaattacagccgctttctaccgcgatatgtctcaagggctcctttattacgactcagaggataatgactgcactgataaggtcatagaaagtatggactttgagcgaagctggcgtggaagaatcctgaaaaacggtgaagatgacaagaatcccttctatatgtttgttaaaggcttggtggggtccaacgataagattgtatgtgagcctatcgacgtggattctgacccagataatttagacattctgatcaacaagaatctaacgggattcggcaggaacctcaaagcaccggactcgaatgataccctggaaaaccttatacggaagatccaggccggtattcccgaggaggaagtcctgcctgagttgaaaaagatcaaagaaatgattcagaaggacatcgtgaatcgcaaggagcagctcctgaaatcaataaagaacaatagaataccatttagcctggaggggagtaaactcgttccctccacaaagaaaatgaagtggttattcaaactgatcgatgtgcctaacaagacttttaatgaaaagatgcttgagaaatactgggaaatttatgactacgataagttgaaagcgaacatcaccaacaggctggacaagacagataaaaaggctcggtctatcagccgcgccgtctccgaggaactacgagagtatcacaagaatctcagaaccaactacaataggttcgtgtcaggagaccggccagcagccggcctggataacggcgggagtgctaaatacaatcccgacaaggaggaatttcttctgttcttgaaagaggtagaacaatattttaagaaatacttccctgttaagagcaagcattctaacaaatccaaggataaatcactcgtggacaagtataaaaattactgcagctataaggtcgtgaagaaagaggtgaaccgtagtattataaatcagctggtcgcaggattaatccagcagggtaagctgctctactatttttactacaacgacacttggcaagaagatttccttaattcttatggcctgtcctacattcaggttgaggaggccttcaaaaagagcgtgatgacatcgttgtcttgggggatcaaccgcctaacctcctttttcatagacgattcaaatacggtaaaatttgacgatattactaccaagaaagctaaggaagccatcgagagtaactatttcaataagctgagaacatgtagcaggatgcaggaccactttaaagaaaagctcgcgttcttttacccagtgtatgtcaaagataagaaagaccggccggatgacgatatcgagaacctgattgtgcttgttaagaacgcaatcgaatccgtgtcttacctgcgaaatcgcactttccattttaaggagagctcattgctcgagctgttaaaagaactggacgataagaacagtggacagaataaaattgactattccgtcgccgctgagttcataaagagagacatcgaaaacctatacgatgtgtttagggagcaaattcggagcctcggcatcgccgagtactataaagcagacatgatctctgattgcttcaagacctgtggtctggaatttgctctttactcacccaagaatagtttgatgcctgccttcaaaaacgtatataagcgcggggcgaatctgaacaaagcctacattagagacaagggaccaaaagagacaggcgatcagggccagaatagctataaggcactcgaagagtacagggaactgacctggtatatagaggttaagaacaatgaccaatcctacaacgcttacaaaaatcttctgcagttgatctattaccacgccttcctccccgaggtgcgtgaaaacgaggctctgattacggattttatcaatcggactaaggaatggaaccgaaaagagacagaagagagattaaacaccaagaataacaaaaagcataaaaatttcgacgagaacgatgacattactgtcaatacatataggtacgaatctatccctgattatcagggggagtcgctggacgattacctaaaggtgctccagcgcaagcaaatggcccgggcaaaagaagtcaacgagaaggaagagggaaataacaattatatacagtttatcagagacgtggttgtgtgggccttcggtgcttacctggagaacaaacttaagaattacaaaaacgaattgcagccacccctgagcaaggagaatattggcctcaacgacaccctgaaggaattatttccggaggagaaagtaaagtcccctttcaatatcaaatgcaggttttcaattagtacgttcatcgataacaaggggaaatctaccgacaacacaagcgcggaagcagtcaagactgatggaaaggaggacgaaaaagataagaaaaatataaagcgcaaagacctgctttgtttttatttgttcctccgactgctagatgagaacgaaatttgcaagctgcagcaccaatttatcaagtaccggtgttccctcaaagagcgtagattccccggcaataggaccaagctggagaaagaaacagagcttttggccgaactggaggaattaatggagctcgtgcgctttactatgccatcaattcctgagatcagcgctaaggccgaatctggttatgacaccatgattaaaaagtacttcaaggatttcatcgagaaaaaggtttttaaaaaccccaagacatccaatctgtattaccacagtgacagcaaaaccccagtgactcggaagtatatggcacttctgatgagatctgcccccttgcatctctacaaagatattttcaaggggtactatctgatcacgaagaaagaatgcctagagtacattaagctgtccaacatcataaaagactatcaaaattcactcaacgaactgcacgagcagcttgagaggattaagttgaaaagtgaaaagcagaatggcaaggacagcctgtacttagataaaaaggacttttataaagtcaaggagtacgtggaaaacctcgagcaggtagctcgatataaacatctgcagcacaagatcaatttcgagtcgctttaccgcatctttcggattcacgtggatatcgccgcaagaatggttggatacacacaggactgggaaagggatatgcatttcctgtttaaggcgctagtctataacggcgtgctcgaggaacgtcgcttcgaggctatttttaataacaatgacgataacaatgacgggcggatagtgaaaaagatccagaacaacctgaataacaaaaatagagaattggtctccatgctgtgttggaacaagaaattaaataagaacgagttcggagccattatctggaagaggaatcctattgcacacctcaaccattttacccaaactgagcaaaattctaaaagctcactggaaagtcttatcaactccctgcgaatattgctcgcctacgatcggaagcgccagaatgctgttaccaaaacaatcaacgacctgctactgaatgattatcacattagaatcaagtgggagggtagggtggacgaaggccagatttacttcaacatcaaagagaaggaagatatagagaatgagccaattatccatcttaaacacctccacaagaaggactgctatatctacaaaaactcttatatgttcgacaagcagaaagaatggatttgcaacgggataaaggaggaagtgtacgataaaagcatcctgaagtgtattggaaatttgtttaagttcgactacgaggataaaaacaagtcctcagccaatccgaaacatacctga

SEQ ID NO: 11276 - RNA, 4314 nt, synthetic construct
  misc_feature 1..4314: note = Cas13a variant__Lachnospiraceae bacterium__WP_022785443.1__Cas13a
  source 1..4314: mol_type = other RNA
atgaagatcagcaaagtgagagaggaaaacaggggcgccaagctgaccgtcaatgctaaaacagcagttgtgtccgagaaccggtctcaggaagggattctctacaatgacccctcacgctatggaaagagtcgtaaaaacgatgaggaccgagatagatacatagaaagcaggcttaagtcctctggtaagctgtatcggatcttcaatgaggacaaaaacaagcgcgagactgatgaattgcaatggtttttatcggagattgtgaaaaagatcaatagaaggaacggcctggtactatcagacatgctcagcgtcgatgaccgggccttcgaaaaagcgtttgagaagtacgctgagctgagttatacgaatcgccgaaacaaggtgtccgggtctcctgccttcgaaacctgcggagttgatgcagccacagctgagagacttaaaggcattatcagcgaaactaattttataaacaggatcaagaataacattgacaataaagtgtccgaggatatcattgaccggatcatagcaaagtacctgaaaaagtcattgtgtcgtgaacgcgtcaaaagaggtctcaagaagctgctgatgaacgccttcgatctcccatatagtgacccggacattgatgtgcagagggactttatcgattacgtattagaggacttctaccacgttcgggctaaaagccaggtgtctcgatccattaagaacatgaatatgcccgtccagcctgagggggatggaaaatttgccatcaccgtgtcaaagggcggcacagaaagcgggaacaaacgcagtgcggagaaggaagcattcaagaaatttctgtctgactatgcctcccttgatgagagagtgagggacgatatgttgcggcgcatgagaaggctggtcgttctatacttctatggaagcgacgattcgaagctctctgacgtgaatgaaaaatttgacgtatgggaggatcatgctgcccgtcgggtggacaaccgagagttcatcaagctgccacttgaaaataaactggcaaacggtaagaccgataaggacgctgagagaattaggaaaaatactgtcaaggaattgtaccgcaaccaaaatataggctgctatcggcaggccgtgaaagcggttgaggaagataacaatgggagatacttcgacgataagatgctcaacatgtttttcatccacaggattgagtatggagtggagaaaatctacgccaatctgaagcaggtcacagaatttaaggcacgcaccggctacttatccgagaaaatatggaaggacctgattaactatatctcaatcaaatacattgctatgggtaaggccgtgtataattacgctatggatgaactcaacgccagtgacaaaaaggagatcgagcttgggaaaattagcgaagagtatctgtccggaatatctagcttcgattacgaattgatcaaggcagaggaaatgctacagcgagagacggccgtatatgttgcttttgcggcacggcatctgtcaagtcaaactgtggagctcgactccgaaaacagcgatttcctgcttctgaagcccaaaggcaccatggacaagaatgacaaaaacaagttggcctctaataacattctcaattttctgaaagataaggagacattacgtgacactatcctgcagtacttcggcgggcactcactatggaccgattttcctttcgacaagtacctcgctggaggtaaagatgacgtcgattttctgacagaccttaaggatgtgatctatagtatgagaaacgacagcttccattacgccaccgaaaatcacaacaatggcaaatggaacaaggagttgatttccgcaatgtttgaacacgagacggagaggatgactgtcgtgatgaaagataagttctattctaataacctgccaatgttctacaagaatgacgatctcaaaaagctgcttatagacctgtataaagacaacgttgaacgcgcctcgcaagtgcccagctttaataaggtattcgtccggaaaaactttcctgctttggtgagagataaggacaacctcgggatcgagctggatttaaaggccgacgcagataaaggagaaaatgagctgaagttctacaacgcgctatattacatgtttaaagaaatttactataatgctttcctcaacgacaagaatgttagggagcgatttatcacaaaagccaccaaggtggcagataactacgaccgcaataaagagcggaacctgaaggatagaattaagtccgccggctcagacgagaaaaagaaacttagggaacagttgcaaaattatatcgctgaaaacgatttcggtcagcgtataaagaatatcgtccaggtgaacccagactacactctggcccaaatttgtcagctcatcatgacagagtataatcagcagaacaatgggtgcatgcagaaaaagagtgcagctcgcaaggacattaacaaagattcttaccagcattataagatgctgttactggtaaaccttcggaaagcctttttggagttcatcaaggaaaattacgcgtttgtgctcaaaccgtacaagcacgacctgtgtgataaggccgacttcgttcccgattttgctaaatatgtcaagccttacgcaggcctaataagcagagtggccggatcctcagagctgcagaaatggtatattgtgagcaggttcctctctccagctcaggccaaccatatgctgggcttccttcactcctacaagcaatatgtctgggacatctaccgacgggcaagtgaaaccgggacggagattaatcacagcatcgcggaagataaaatagccggagttgacatcaccgatgtggacgctgtgattgatttgtctgtaaagctgtgcggtacaatctcctcagagattagtgactattttaaggatgacgaggtctacgccgaatacatcagctcgtatttagacttcgagtacgatggcgggaactataaagactccctcaatcgcttttgtaactctgatgcagtgaatgaccagaaggttgctctgtactatgatggagaacatcccaaacttaacagaaatataattctgagcaagttgtacggcgagaggcggttcctcgagaaaatcactgaccgagtgtcaagaagtgatatcgtcgaatattacaagctgaagaaagagacctcccagtaccagacaaagggtatttttgactctgaagatgagcagaaaaacatcaagaaattccaagaaatgaagaatattgtggagtttcgcgacctaatggattatagcgaaatagccgacgagctgcaggggcagctcatcaactggatttacctgagggagcgtgatcttatgaatttccaattgggctatcactacgcatgcctgaacaatgactccaacaaacaggccacttatgttaccttagactaccagggaaagaagaatcggaaaatcaacggcgctattctctatcaaatctgtgcgatgtacataaacgggctgcctctttactatgtggataaggactcaagcgaatggacagtaagtgatggaaaagagtctaccggtgccaagatcggcgaattttacagatatgcaaaatccttcgagaatactagcgactgctacgcttcggggctggagatttttgaaaacatctcagagcatgataatattacggaactaaggaactatatcgagcacttccgctactattctagtttcgaccgatcctttctcggaatatacagcgaagtcttcgatagatttttcacatacgacctgaagtatcggaagaatgtgccaaccattttgtacaacatcctgttacagcattttgtgaatgtcaggttcgagtttgtttctggcaaaaagatgatcggtattgataaaaaggaccgcaaaatagccaaggagaaggaatgtgcccgtatcactattagagagaaaaacggggtgtatagcgaacagttcacctacaagctcaaaaatggcacagtatatgtggatgctcgggacaagaggtacctgcagtccatcattcgccttctgttttatcccgagaaagtcaacatggacgaaatgatcgaggtgaaggagaagaaaaagccgtcagataataacaccggaaaaggctacagtaagcgagacagacaacaggatcggaaagaatacgacaagtataaagagaagaagaaaaaggaagggaatttcttgagcggaatgggcggtaacataaattgggatgagatcaacgcacagctcaaaaactga

SEQ ID NO: 11277 - RNA, 3156 nt, synthetic construct
  misc_feature 1..3156: note = Cas13a variant__Listeria newyorkensis__WP_036091002.1__Cas13a
  source 1..3156: mol_type = other RNA
atgaagatcaccaaaatgagagtggacggcaggacaattgtcatggagcggactagcaaggaagggcagctgggatacgagggtatagatggcaacaaaacgaccgaaatcattttcgacaagaaaaaggagtccttttataagtctatcctcaataaaacagttcgcaagcccgatgaaaaagagaagaaccgacgtaaacaagccattaataaggctatcaacaaggagataactgaacttatgctggcagtgttgcaccaggaggtaccttcacagaaattacataatctgaagagtctaaacaccgaaagcctcacaaaactgttcaagccaaaatttcagaatatgatctcctacccgccctctaagggggccgagcacgtgcaattctgccttaccgacattgcggtccctgctatcagagatctggacgagattaaaccagattggggaatctttttcgaaaagttgaagccctatactgactgggccgagtcgtacatacattataaacagacaaccattcagaagtcaatcgaacagaacaaaattcaaagccctgatagtccaaggaagctcgtgctgcagaaatacgttacggcatttctgaatggcgagcccctcggtttagacctggtggccaagaagtataaacttgctgatttggcagaatccttcaagctggtcgacctaaacgaggataaatctgccaattacaagatcaaggcttgtctccagcagcaccaacggaacatcctggacgagcttaaagaagaccctgagctgaatcagtacgggattgaagtgaagaaatatatacagcgctactttccaatcaagagagccccgaacaggagcaaacatgcgcgggcagatttcttgaagaaagagctcattgaatccactgtagagcaacagtttaagaatgccgtttatcactacgtgctggagcagggaaagatggaggcttatgaattaaccgaccccaaaacaaaggatctgcaggacatccgctcaggcgaagccttcagttttaaattcataaacgcatgcgctttcgccagcaacaatctcaagatgattcttaaccctgagtgtgaaaaagatatcctgggcaaggggaattttaaaaagaacttgccaaattctactacccgatccgacgtcgtgaagaaaatgatccccttcttttcagatgagctacaaaacgtgaatttcgacgaggcgatttgggccatcagaggaagcattcagcagataaggaacgaagtctaccactgcaagaaacatagttggaagtctatcctgaaaattaagggttttgagttcgaacctaataacatgaagtatgcagattccgacatgcagaaactcatggataaggacatcgctaaaatcccagagtttattgaggaaaagctgaaaagctcgggcgttgtgcggttctaccgtcacgacgagcttcaatctatatgggaaatgaagcaggggttttccctgttgacaaccaatgcccccttcgtaccgtcatttaagcgcgtgtacgctaaaggacatgattatcagacgagtaagaacagatactataatctcgacctgactacattcgatatcttagagtacggcgaagaggactttagggcccggtatttcctgaccaaactggtctactatcagcaattcatgccttggtttactgcagataacaatgccttccgagacgctgcgaactttgtgctccgcctgaacaagaatagacagcaggatgcaaaagccttcattaacatcagggaggttgaagagggtgaaatgccccgggactacatggggtacgtgcagggacaaattgctatccacgaggatagcatagaagacacaccaaatcactttgagaagttcatctcccaggtctttattaagggcttcgatcgccatatgagatctgccaaccttaaatttatcaagaatcctaggaaccagggcttggagcaaagcgaaattgaggaaatgtcattcgacatcaaagtggagcccagttttctgaagaataaagatgactatatagcattctggatcttttgtaagatgctcgacgcccgtcacctgtccgaacttcggaacgagatgattaaatacgatgggcatctgaccggagagcaggaaattatcggtttggctctcctgggcgtagacagccgagagaatgattggaagcagttcttctcttcagaaagagagtatgagaagataatgaaagggtacgttgtggaagagttatatcagagggaaccataccgccaaagtgacggaaagacgcccatcctgtttcggggcgtcgagcaggccagaaaatatggtaccgaaacagtgattcagaggctattcgatgcaaaccctgagtttaaggtcagcaaatgcaatctcgcggagtgggaacgccagaaggagactatcgaagagaccattaagcgacggaaagaactgcacaacgagtgggctaagaatccgaaaaagccacaaaacaatgccttctttaaagagtacaaggaatgttgcgacgcaatcgatgcctacaactggcataagaacaaaacaactcttgcttatgtgaatgagttgcaccacctactcatagaaattctggggcgttacgttggctatgtggccatcgcagacagagatttccagtgtatggctaaccagtactttaagcattccggaatcaccgagagggtagaatattggggcgacaatcgcttaaaatctattaagaaactggatacattccttaagaaggaggggttgtttgtctcggagaaaaacgcccggaatcacatcgcgcatctcaactacctgagcctaaagtccgaatgcaccctgctctatctgtcagagagacttagggaaattttcaaatacgaccgaaagttgaaaaatgccgtgagtaagtctctgatagatatcttagaccgccacggaatgagcgttgtgtttgctaacctcaaggagaataaacaccggctggtcattaagtcccttgagcccaaaaagctgagacatttgggtggcaaaaagatcgacgggggatacattgaaactaaccaggtgtcagaggaatattgtggcatcgtaaaaaggctcctggagatgtga

SEQ ID NO: 11278 - RNA, 3363 nt, synthetic construct
  misc_feature 1..3363: note = Cas13a variant__Listeria seeligeri__WP_012985477.1__Cas13a
  source 1..3363: mol_type = other RNA
atgtggatcagcattaagaccctgatacaccatctcggcgtgcttttcttttgcgactacatgtataacagaagggagaaaaagatcattgaagtcaaaacaatgcggatcactaaggttgaggtggatcgcaaaaaggtactgatttcccgagacaagaatgggggaaaattggtgtacgaaaacgagatgcaggataatacggaacaaatcatgcaccataagaaatcttcattctataagagtgtcgtgaacaaaaccatatgtcgtcccgagcagaagcagatgaagaaattagttcacggtctgctacaggagaatagccaagaaaagatcaaagtgtccgacgtcacaaagctcaacatttctaattttctgaaccatagattcaaaaagtcgctttactattttcctgaaaattcaccagataaaagcgaagagtacaggatcgagattaacctgagtcagttgctcgaagactccctgaagaagcagcagggcactttcatctgctgggagtcttttagcaaagatatggaactgtatataaattgggccgagaactacatttcctcaaagaccaaactcatcaagaaaagtattcggaataaccgcatccaaagcacagaatctagatccgggcagttaatggacaggtacatgaaggatatcctgaataagaacaaaccgttcgacattcagtcagtgagcgagaagtatcagcttgagaaattgaccagtgctctgaaggcaacttttaaagaagccaagaagaacgataaagagataaattacaagctaaaatctacactccaaaaccacgaacggcagatcattgaggaactgaaggaaaattccgagcttaaccagttcaatatcgaaatacgcaaacacctggagacctattttcccattaagaagacgaaccgaaaagtaggagacatcagaaatttggaaatcggcgagattcaaaagatcgttaaccataggctcaaaaataagattgtgcagcggatactgcaggaaggtaaattagcgagctacgagatcgagtcgactgtcaactctaattccctgcagaagattaaaatcgaagaggctttcgccctcaagtttatcaacgcatgtcttttcgcctcaaataacctgcgtaatatggtgtatcctgtgtgcaagaaagatattttgatgataggggagttcaagaacagttttaaagagatcaagcacaaaaagttcattcgccaatggagccagtttttctcccaggagatcaccgtcgacgacattgaactagcttcttggggactgagaggcgcaatcgccccaataaggaacgagatcattcatctcaagaaacacagctggaagaaatttttcaataaccccacatttaaggttaaaaagtcaaagatcattaatggcaaaactaaggatgtgaccagtgagttcctgtacaaagagacactttttaaggactatttctactccgaactggatagcgtacctgagttgatcataaacaaaatggagtcttcaaagattctcgactactatagtagcgatcagctgaatcaagtgtttaccatcccaaacttcgaattatccctgctaacgtctgctgtcccctttgccccttcgttcaagcgggtgtacctcaaagggttcgactatcagaatcaggatgaggcgcagccagactacaacctgaaacttaatatttataacgaaaaagcatttaatagcgaggccttccaagctcagtactccttgtttaagatggtttattaccaggtgttcctgccgcagtttactacaaacaatgatctcttcaaatcaagtgtcgactttatcctgacccttaacaaggaacgaaaaggatacgccaaggcattccaagatatacgcaagatgaataaagacgagaagccctctgagtatatgagctacatccagtcccagctgatgttgtatcaaaagaagcaggaagagaaagaaaagattaaccactttgagaagttcatcaaccaggtgtttattaaaggtttcaattcatttatcgaaaagaacagactcacttacatatgtcatcctaccaaaaatacagtaccagagaacgacaatattgagatccccttccacacggatatggacgatagcaacatcgctttctggctgatgtgcaagttactggacgccaaacagctatctgaactcaggaatgagatgattaagttttcctgtagtctgcaaagcaccgaagagatctctacattcactaaggcgcgggaggttattggccttgccttgctgaacggggaaaaaggatgcaatgattggaaggagctctttgacgataaagaagcatggaagaaaaacatgtccctgtatgtgtcagaggaattactgcagagtcttccttacacccaggaggacggccagacaccagtcataaatcgcagcatcgatttggtgaagaagtatggtactgagaccattctcgaaaaactgttctcgtcctctgacgattacaaggtcagcgctaaagacatcgccaagctacatgagtacgatgtgacagagaaaattgctcaacaggaatcactgcacaagcagtggatcgaaaagcccgggctcgccagagacagtgcatggaccaaaaagtatcagaacgttataaatgacatctccaactaccaatgggccaaaactaaggtggagctgacgcaggtaaggcatcttcaccagttgacaattgatctgttatctcgtctcgctggatatatgagcatcgcggaccgggattttcaattctcctcaaattacattctggagcgagaaaacagcgagtatagagtcaccagttggatccttctgtctgaaaacaaaaataagaacaaatacaatgactatgagttgtacaacctcaagaatgcatccataaaggtgagctcgaaaaacgatccgcagctgaaggttgacctaaaacagctgaggctcactctggaataccttgagttgtttgataatcgcctgaaggagaaacggaacaatatttcacacttcaactatttaaatggccagctcggcaactctatcctggaactttttgacgatgccagagacgtgctgagttacgataggaagctaaagaatgctgtctccaaaagcctcaaggagatcctgtctagccatgggatggaagtgaccttcaaacctttgtatcaaacaaaccaccatctgaagattgacaaattacagcccaagaagatacaccacctcggagagaaatccaccgtatcaagtaatcaggtgagcaacgagtactgtcagctggttcgcactcttctgacaatgaagtga

SEQ ID NO: 11279 - RNA, 3465 nt, synthetic construct
  misc_feature 1..3465: note = Cas13a variant__Paludibacter propionicigenes__WP_013443710.1__Cas13a
  source 1..3465: mol_type = other RNA
atgagagtgagcaaggtcaaagttaaggacggcgggaaagataagatggtgctggtacacaggaaaaccacaggagcccagctcgtgtactccggtcaacccgtctctaacgagacttcaaatatccttcctgaaaagaagcggcagagtttcgacctgagcacgttgaacaaaaccattataaagtttgatacagctaaaaagcagaaattaaatgtggaccagtataagatcgttgagaagattttcaaatacccaaagcaagaactgccgaaacagatcaaggcagaggaaattctaccctttctcaaccataaattccaggagcctgtgaagtattggaaaaatggcaaggaggaatcctttaacctgactcttctgatcgtcgaggccgtgcaggcgcaagataagcgcaaattgcagccatactatgactggaagacctggtacatacagacaaaatctgatctcctgaagaaatcgatcgaaaataaccgaattgacctgaccgagaatctctcaaagcgtaagaaggctttactggcctgggagactgagttcacagcaagcgggagtatcgatcttacccactatcataaggtatacatgacggacgttttgtgcaaaatgctgcaggatgtgaagcccctaactgacgataaaggaaagattaacaccaatgcctaccacagaggcctcaagaaagctctgcaaaaccatcagcctgcaatctttggtacaagggaagtcccaaatgaagccaaccgggctgacaatcagctttccatatatcacctggaggtggtgaagtacttggaacactatttccccattaaaacttctaagcgcagaaacaccgccgacgatatcgcgcattacctcaaagcacaaacactgaagaccacgattgagaagcagttagtcaacgccatcagggctaatatcattcagcaggggaaaactaaccaccatgagctgaaggccgacacaaccagcaatgatctcatacggatcaaaactaacgaagcatttgttcttaatctgacaggaacctgtgctttcgccgcgaacaatattcgcaacatggtggacaatgagcaaacgaacgatatcttgggcaagggcgactttataaaatccctactgaaggataataccaactcacagctctatagtttctttttcggggaaggactgagcacaaataaagccgagaaggaaactcagctttggggtattcgaggcgcagtacagcaaatcagaaacaatgtgaaccactacaagaaagacgctctgaagaccgtcttcaacatctctaattttgagaaccctacaattactgatccaaaacagcagaccaattatgccgacacaatctacaaggctaggttcattaacgagttggagaaaataccggaagcctttgcacagcaactcaagaccgggggagccgtgtcctactatactatcgaaaatctgaagtcattactgacgacattccagtttagcctatgccggagtaccattcccttcgctcctggctttaaaaaggttttcaacggtgggatcaattaccagaacgcgaaacaggatgagtctttttatgaactcatgctggagcaataccttcgtaaggagaatttcgcagaagagtcctataacgcccgctactttatgttgaaactgatctataataacctcttcctgccaggatttactaccgacagaaaggctttcgccgacagcgtgggcttcgtccagatgcagaataagaaacaagcagaaaaggtgaaccccaggaaaaaggaggcctacgcttttgaggccgtacggcctatgacagcagcggattcgattgctgactacatggcctatgttcagtctgaacttatgcaggagcagaataaaaaggaagagaaggtggcagaagagacccgaataaacttcgagaaatttgtcctgcaagtgttcatcaagggctttgattccttcttgcgcgccaaagaatttgacttcgtccagatgccacagccccagctcactgctacagcctcaaaccaacagaaggcagataaactgaatcagttagaggctagtattacggccgactgtaagctgaccccgcagtacgcgaaagccgatgacgctactcacatcgcattttatgtgttctgcaagctactcgatgccgctcatctgagcaaccttagaaatgaattgattaagtttagggagtccgttaacgagttcaaatttcaccatctgctcgaaatcatagagatctgtctgttatctgccgacgtggtacctacagattaccgggacctgtatagctcagaagcagattgccttgcgcgcttgagacccttcattgagcaaggggccgacatcaccaattggagtgacctcttcgtccagtccgataagcacagcccagtgattcatgctaacatcgaactgtctgttaaatacggaacaactaagctactggagcagataattaataaagacacccaatttaagacgaccgaagccaacttcacagcatggaatactgctcagaagtcaatcgagcagctcattaaacagagggaggatcaccacgaacaatgggtgaaggccaaaaacgcagacgataaggagaaacaggaacgtaagcgggagaagagtaattttgcccagaaattcatcgagaagcatggtgacgattatctggacatatgtgattacatcaacacctacaattggcttgacaacaaaatgcactttgtccatttgaatcgactgcacggcttaacaattgaactcctggggagaatggctggattcgtggcgctttttgatagggacttccagtttttcgatgagcaacagatcgccgacgaatttaagctgcacggcttcgtaaacttgcatagcattgacaaaaagctcaacgaggtgcctactaagaaaatcaaggaaatatatgatattcgcaataaaatcatccagattaacggtaataagatcaacgagtccgttcgggcaaatctgattcagttcatatcttcgaaaagaaactactataataacgcttttctacacgtcagcaatgacgagatcaaggaaaagcaaatgtacgatattaggaaccatatcgcccacttcaattatctgaccaaagacgccgctgatttttccctcattgacctgatcaacgagcttcgcgaattgctgcattacgatcgaaagctcaaaaatgcagtgtcaaaggccttcatagacttatttgataaacacgggatgatcctgaaacttaaactgaacgcggaccacaagctaaaggtggagagtctcgaacccaaaaagatttatcatctgggctctagcgctaaagataagccagagtaccagtactgcacgaatcaggtcatgatggcctattgtaacatgtgccggtccttgctggagatgaaaaagtga

SEQ ID NO: 11280 - RNA, 3858 nt, synthetic construct
  misc_feature 1..3858: note = Cas13a variant__Rhodobacter capsulatus__ETD76934.1__Cas13a
  source 1..3858: mol_type = other RNA
atgcagatcggcaaggtgcaagggagaaccattagcgagttcggagaccccgccggtggcctgaaaaggaagatatccacagatgggaaaaaccggaaggaactccctgctcacctttcttcagacccaaaagcactgatcggacagtggattagtggcatcgataagatttaccgcaagccggacagccgaaaatccgatggtaaggccatccattctcccactccttcgaaaatgcagtttgacgcgcgtgatgacttgggggaggctttctggaagttagtctcagaagccggactggcacaggatagcgactatgatcaatttaaaagaaggctacacccatacggcgacaagttccagcccgccgatagtggcgctaagctcaaatttgaggcagaccctccagaaccccaggccttccatgggcggtggtatggagctatgtccaagcgcggtaatgacgccaaagagctggcggcagccctttacgagcacttacatgttgatgaaaagagaatagacggccagcctaaaaggaacccaaagacggataaatttgctccggggttggtggtagcccgggcactcggaatcgagtctagcgtgctgccccgcggcatggctcgactggccagaaattggggtgaagaggagattcaaacctatttcgtcgtggacgttgcggcctccgtgaaggaagtcgcaaaggctgccgtgtcagctgcccaggcatttgatcctccaaggcaggtaagtgggcggagcctctctcccaaagttggattcgccttagctgagcacctggaacgtgtgacaggctccaagcgctgctcatttgaccctgcggcaggcccaagcgtccttgccttgcacgatgaggtgaaaaagacttacaaaagactgtgtgctagggggaagaacgccgcacgggccttccccgctgacaagaccgaactactcgccctgatgcgacatacacacgagaatcgcgtgagaaaccagatggtcaggatgggacgggttagtgagtatcgcggtcaacaggcaggcgatcttgcgcagtctcattactggacctccgctgggcaaactgaaatcaaagagagcgaaatttttgtgagactgtgggtaggagccttcgcattggccggcaggtcgatgaaggcttggatcgacccgatgggtaaaatagtgaatacagagaagaacgatcgtgacctcaccgccgcagtcaatattcgacaggtgatctctaacaaagaaatggttgctgaggccatggcgcggagagggatttacttcggcgagacgcctgaactggacaggttaggagccgagggcaatgaagggtttgtgttcgctctgctccgctatcttcggggatgcagaaaccagacttttcacctgggtgcaagggccggcttcttgaaggagatccgcaaggaactagagaaaacccgatgggggaaggctaaagaggccgaacacgtcgtgctgacagataagactgtagcagcgatccgggccattatagacaatgatgctaaagccctcggagcacgtctgcttgctgacctgtccggcgcctttgttgcacattacgcctcaaaggagcacttcagtaccttgtatagcgaaatcgtgaaggctgtcaaagatgcgcccgaggtgtcctctggtctcccaagactgaagttactgctaaaaagggccgacggggtccgcggctacgtgcatggactccgggatacaagaaagcacgcatttgctaccaaactgcctcccccacccgcccctagggagcttgacgatccagccacgaaggctcgatatattgcattgctgcgcctctacgacggcccgttccgggcctatgcgagcgggatcactggaacagctctggccggtcccgcagccagagctaaagaagcagccaccgcgcttgctcagtcagttaacgtgactaaggcctacagtgatgtaatggagggcaggtccagccgtctgcgccctccaaatgacggggaaacattgcgggagtacctctctgcactgaccggagaaacggccaccgagtttagagtccaaataggctatgagtcagatagtgaaaacgctaggaagcaggccgagttcattgaaaactaccgacgggacatgttagcatttatgttcgaggactatatccgcgctaaaggttttgattggatcctgaagattgaacccggggccacagcgatgactagagcccctgtgctaccagagcccatcgacaccaggggccagtacgagcattggcaggcagctctctatctggttatgcacttcgtgccggccagcgatgtctccaatcttttgcaccaactgcggaaatgggaagctctccagggaaagtacgagctggtgcaggacggcgatgcaacagaccaggccgatgcccgaagagaagctctggacctggtaaaacgcttcagggatgtgcttgttttgtttctcaagactggggaggcgcgtttcgaaggacgggcagccccttttgacctgaagccattcagagctctatttgccaaccccgcaaccttcgataggctgtttatggccacacctaccactgctcgccccgcggaggacgatccagagggcgacggtgcctctgaacctgagctccgagtcgcaagaacgctgcgggggcttaggcaaattgctcgctataatcatatggccgtgttgtcggacctgttcgcaaaacacaaggtgcgtgatgaagaggtcgccagattagctgagatagaagacgagacacaggaaaagagccagatcgttgccgcgcaggagctccggaccgatctgcatgacaaggtgatgaaatgtcaccccaagactatttccccagaagagaggcaatcatacgcagccgctatcaagaccatcgaggaacaccgctttcttgtgggacgagtatacctgggcgatcatttgagactccaccggctgatgatggacgtcattggtaggctaatagattatgccggcgcttacgagcgcgacacagggaccttcctgatcaacgcaagtaaacagctcggagccggcgctgattgggccgtgactattgcaggggcggccaatacagacgctagaacgcagaccaggaaggatctggcccattttaacgttcttgaccgggcagacggaactccggatttgacagctctggtgaatcgtgcccgcgaaatgatggcatatgaccgaaaaagaaagaacgccgtccctaggtctatcttagatatgctcgctcggctgggccttaccctgaaatggcaaatgaaggaccacctactccaggatgcgacaattactcaggccgcaatcaagcatctggacaaagtgcgcttgaccgttggtgggcccgctgccgtgacggaggccagattcagccaggattacctgcaaatggtagcagctgtctttaatggatccgtgcagaacccaaagcccaggcggcgagacgatggcgacgcctggcacaaacctccaaagcccgcgaccgctcagtcacagcctgatcaaaaaccgccaaataaggcccccagcgcaggttctagattacctccaccccaggtgggcgaagtctatgagggggttgtggtaaaagtgatagacacaggatccctcggcttcctggccgtcgagggggtggctggaaacatcggccttcacattagtcgcctgaggcggatccgtgaagatgcaattatcgttggtagaaggtaccgcttccgggtggagatatatgtccctccgaaaagcaatacttctaagttgaacgccgcggacctcgtgcgaattgactga

SEQ ID NO: 11281 - RNA, 1578 nt, synthetic construct
  misc_feature 1..1578: note = Cas13a variant__Corynebacterium ulcerans__WP_038617242.1__Cas13
  source 1..1578: mol_type = other RNA
atgcccaagtactgcctgaccgccagattccctctcggcgtgtatcttgggcacacaggagacgctaacagggatgcatacccagacccggcccggctgcatgcggctttgatgaatgccgcagcccagggtgtccacgctgaggaagatcccaacgagcatcaattacgccctagccagcagtccctgcaggcactacaatggctcgaagcccacccacccactggcctggctatgcctgagcagcagtggctttctccagacacgtcacgaatgatgtatcgtaatgttgggagtgtgaaaatcgataagaccggagtaacaagagccactgaaaacagggcggtgagcgacggcgtctccgtgaatggtgcatacgggtatatttgggatgagatgcccgttgacatagccgaggctatcaccgccctgttgcctgatgtggcatgtctcggagaggcttcttcgctggtcgtgctggaacagcaagaaattgaggccacactcaccttagacccacaggcgactgccttttcaacagagcgggtacaggttcgcatcgcactgccgggcagaacccagcatcttagggaagtgttccacgctcggtacggcaaaaagccccctagcaaaaaggccgataagtttttgaaagacgatccaattcacgatccccctatcccaaaggaccatctggggacggctcgctatctacgagtcaacgccgcagacaaagagtgcgtgactccctggaccaaggtgatactcctggaagtccacggaaaacaacttggtgccaaggagcaggttagagctgcggtggcactgcatagggccttgatcgctcggattcgtacagacgtaagtccggtgatcactggccgctacgccgcaggggcccagagacctgctaataacctcgccattcaatacatcccccacaggcacctggaagcattaggactgaagacctccgcgttcgctctccttgtcccacaggatgccgactctacagtgtatgagcagctgaatcaggcattgaccggcccttttcccctacggagcggtgggaaactgctctgtcaactgaagtacaacggacatgttttccgaggcgatgccttttggccagctccccagcctggcacgatacgcatgtgggagccacttaatgtgttcattccggaatccagaccccacaacaaacagcagggggtcctgtggaggttggccgacgcaggactcctgtcagtggcttttgtatggcgggataatttccctactaaggagacaggtccagcccgctatgttgaattaagagacgcggcctacaacgctgatgtgaggatctttcatgaccaccccgtcagtcgtaatacccggcgattcgtgcatagaactaacaggagcctgacaattcaaccttggcgcggcctagtccacctcgggtctctgcagcaggatcgggcaatcatcgcccttggacagtccagacacttgggcggtgggctgctcattccagtggacatacccaggtcagagtttgaaaccatgacgagcgagatgacccatgcttga

SEQ ID NO: 11282 - RNA, 3675 nt, synthetic construct
  misc_feature 1..3675: note = Cas13b variant__Bergeyella zoohelcum__WP_002664492.1__Cas13b
  source 1..3675: mol_type = other RNA
atggagaacaagaccagcctgggcaataacatctactataatcccttcaaacctcaggacaagtcctactttgccgggtatttcaacgctgcaatggaaaatacagattctgtgtttagagagctcggaaaaaggcttaagggtaaagaatacacttcagagaacttctttgacgccattttcaaggaaaatataagtctggtcgagtatgagcggtacgttaagttgttaagcgattattttccaatggcgcgcctgctagacaaaaaggaagtgccgatcaaagagcgaaaggaaaacttcaaaaagaattttaagggcattatcaaagctgtacgtgatctcagaaacttctacacgcacaaggagcatggggaggtggaaattaccgacgagatctttggagtcctggatgaaatgcttaaatccacagtgctgactgttaagaaaaagaaagtgaagaccgacaagacaaaagagatattgaagaaatctatcgaaaagcaactcgatattctgtgccagaaaaagctggagtacctcagggacaccgcccggaagatcgaggaaaaacgcagaaatcagagggagcggggcgaaaaggagttagtcgcacccttcaaatattcggataagcgcgacgatctgattgccgctatctacaacgacgcatttgacgtgtatatagataaaaagaaggactcacttaaagaaagcagtaaggccaaatacaatactaagtccgatcctcagcaagaggagggtgacttgaaaattccaatctctaagaacggggtagttttcctgctaagcctcttcctgacaaagcaggaaattcacgcttttaaatccaagatcgccggattcaaagcgaccgtgatcgatgaggcaacggtctcagaagccactgtgagtcatggcaagaatagcatttgttttatggctacccacgagatattctctcatcttgcctataaaaagctgaaacgaaaggtgagaacagcagaaatcaactacggcgaggctgagaacgccgaacagttgtccgtctatgcgaaggagactctcatgatgcagatgctggacgaattatcaaaagttcccgatgtggtataccaaaatctgagcgaggacgtgcagaagacctttattgaggattggaacgaatacctcaaagagaataacggggacgtcggaacaatggaagaggaacaggtgatccaccctgttataaggaagcggtatgaggataaattcaattactttgccattcgtttccttgacgagtttgcacagttcccaaccctgcgctttcaagtgcacttgggtaactatctacatgacagtagacccaaggaaaatctgatctctgataggcggatcaaggagaaaattacggtcttcggccgactctccgaactggagcacaagaaagctctttttatcaagaacactgaaacaaatgaggaccgcgagcattactgggaaattttccctaacccaaattatgatttcccgaaagagaacataagcgtgaatgacaaggattttcccatcgccgggtcgattctggacagagaaaagcagcctgtagctggaaaaatcggcatcaaggttaaattgctcaaccagcaatacgtgtctgaggtcgataaggccgtgaaagcacaccagctgaagcagaggaaggcctccaaaccatcaattcagaatataatcgaagagattgtccccatcaacgagagtaaccctaaggaagctattgtgttcggtgggcaaccaaccgcgtatttaagcatgaatgacatccactccatactgtacgagtttttcgataaatgggaaaagaaaaaggagaaactagagaagaagggagaaaaagagctccggaaggaaatcggcaaagagctggaaaagaaaattgttggcaagatccaggcacagattcagcaaatcatagacaaggatactaacgccaaaattcttaagccctaccaggacggaaattctacagctatcgataaagagaagttgattaaagacctgaagcaggagcagaacatcctccaaaagctgaaagacgaacagaccgtgcgcgagaaggaatataatgattttatagcctaccaggacaaaaacagagagatcaataaggtaagggatcgtaaccataaacagtatcttaaggacaatctgaagcggaaatacccggaagcccctgcacgaaaggaggtcttgtattacagagagaaagggaaggtggctgtttggctcgccaacgatattaaaaggttcatgcccacggactttaagaatgaatggaagggtgagcaacacagcctgttacagaaatcactggcatattacgaacagtgcaaggaggaactcaaaaacctactgccagagaaggtgttccaacatcttccttttaaattgggcgggtacttccagcagaagtatctgtaccagttttatacctgttacctcgataaacgcctggagtatatcagtggattagtccaacaggcggaaaatttcaagtccgagaacaaggtgtttaaaaaggtagaaaatgagtgcttcaaattcctgaagaaacagaactacacacacaaggagcttgacgctcgggtgcagagcattttgggctatcccatctttctcgaaagaggtttcatggatgagaagccaactataattaaagggaagacctttaaaggcaacgaagccctgttcgcagactggtttaggtactacaaggagtatcaaaatttccagacattttacgatactgaaaactatcccctagttgagctggagaaaaagcaggccgaccgcaagcgaaaaaccaagatctaccagcagaaaaagaatgatgtcttcacactcctgatggctaaacatatctttaagtctgtgttcaagcaagactcaattgaccagtttagtcttgaagatttgtatcaaagccgggaggaacgtctgggaaaccaggagagagccaggcagaccggcgaacgcaatactaactacatctggaataaaacggtggacttaaagctctgtgatgggaaaattacagtcgagaacgttaagctgaaaaatgtgggagacttcataaagtatgagtacgatcagcgggtgcaagcattccttaaatacgaagagaacatcgaatggcaggcttttctgattaaggagtccaaggaagaggagaattatccttacgtagtcgaaagagagatcgaacagtatgagaaagtgaggcgagaggaattgctcaaggaggttcacctgattgaagagtacatcctagaaaaagtgaaggacaaagagatactgaagaagggtgataaccagaatttcaaatattacatcctcaacggcctgcttaagcaattgaaaaatgaggacgtcgaatcttataaggtgtttaacctgaacaccgagccagaagatgttaatattaaccagttaaaacaggaggccactgacctcgaacagaaggcgttcgtgctgacctacatccgcaataagtttgcccacaaccaacttccgaaaaaggagttctgggattactgccaggagaaatatgggaagattgaaaaagagaagacatacgctgaatattttgcagaggtattcaagaaagaaaaggaggccctgatcaaatga

SEQ ID NO: 11283 - RNA, 3675 nt, synthetic construct
  misc_feature 1..3675: note = Cas13b variant__Bergeyella zoohelcum__WP_002664492.1 modified__Cas13b(R116A,H121A,R1177A,H1182A)
  source 1..3675: mol_type = other RNA
atggagaacaagaccagcctgggcaataacatctactataatcccttcaaacctcaggacaagtcctactttgccgggtatttcaacgctgcaatggaaaatacagattctgtgtttagagagctcggaaaaaggcttaagggtaaagaatacacttcagagaacttctttgacgccattttcaaggaaaatataagtctggtcgagtatgagcggtacgttaagttgttaagcgattattttccaatggcgcgcctgctagacaaaaaggaagtgccgatcaaagagcgaaaggaaaacttcaaaaagaattttaagggcattatcaaagctgtacgtgatctcgccaacttctacacggcaaaggagcacggggaggtggaaattaccgacgagatctttggagtcctggatgaaatgcttaaatccacagtgctgactgttaagaaaaagaaagtgaagaccgacaagacaaaagagatattgaagaaatctatcgaaaagcaactcgatattctgtgccagaaaaagctggagtacctcagagacaccgccaggaagatcgaggaaaaacggcgcaatcagagagagaggggcgaaaaggagttagtcgctcccttcaaatattcggataagcgggacgatctgattgcagccatctacaacgacgcttttgacgtgtatatagataaaaagaaggactcacttaaagaaagcagtaaggccaaatacaatactaagtccgatcctcagcaagaggagggtgacttgaaaattccaatctctaagaacggggtagttttcctgctaagcctcttcctgacaaagcaggaaattcatgcgtttaaatccaagatcgcaggattcaaagccaccgtgatcgatgaggctacggtctcagaagccactgtgagtcacggcaagaatagcatttgttttatggcaacccatgagatattctctcaccttgcttataaaaagctgaaacgcaaggtgcgaacagccgaaatcaactacggcgaggcggagaacgccgaacagttgtccgtctatgcaaaggagactctcatgatgcagatgctggacgaattatcaaaagttcccgatgtggtataccaaaatctgagcgaggacgtgcagaagacctttattgaggattggaacgaatacctcaaagagaataacggggacgtcggaacaatggaagaggaacaggtgatccatcctgttataagaaagaggtatgaggataaattcaattactttgctattcggttccttgacgagtttgcccagttcccaaccctgcgttttcaagtgcacttgggtaactatctacacgacagtcgccccaaggaaaatctgatctctgatagaaggatcaaggagaaaattacggtcttcggccggctctccgaactggagcataagaaagctctttttatcaagaacactgaaacaaatgaggaccgagagcactactgggaaattttccctaacccaaattatgatttcccgaaagagaacataagcgtgaatgacaaggattttcccatcgccgggtcgattctggaccgcgaaaagcagcctgtagcaggaaaaatcggcatcaaggttaaattgctcaaccagcaatacgtgtctgaggtcgataaggccgtgaaagctcatcagctgaagcagagaaaggcgtccaaaccatcaattcagaatataatcgaagagattgtccccatcaacgagagtaaccctaaggaagcaattgtgttcggtgggcaaccaaccgcctatttaagcatgaatgacatccactccatactgtacgagtttttcgataaatgggaaaagaaaaaggagaaactagagaagaagggagaaaaagagctcaggaaggaaatcggcaaagagctggaaaagaaaattgttggcaagatccaggctcagattcagcaaatcatagacaaggatactaacgccaaaattcttaagccctaccaggacggaaattctacagcaatcgataaagagaagttgattaaagacctgaagcaggagcagaacatcctccaaaagctgaaagacgaacagaccgtgcgggagaaggaatataatgattttatagcctaccaggacaaaaaccgcgagatcaataaggtaagagataggaaccacaaacagtatcttaaggacaatctgaagcgtaaatacccggaagctcctgcccggaaggaggtcttgtattaccgagagaaagggaaggtggcagtttggctcgcgaacgatattaaaagattcatgcccacggactttaagaatgaatggaagggtgagcaacatagcctgttacagaaatcactggcttattacgaacagtgcaaggaggaactcaaaaacctactgccagagaaggtgttccaacaccttccttttaaattgggcgggtacttccagcagaagtatctgtaccagttttatacctgttacctcgataaaaggctggagtatatcagtggattagtccaacaggccgaaaatttcaagtccgagaacaaggtgtttaaaaaggtagaaaatgagtgcttcaaattcctgaagaaacagaactacacacataaggagcttgacgcacgcgtgcagagcattttgggctatcccatctttctcgaacggggtttcatggatgagaagccaactataattaaagggaagacctttaaaggcaacgaagccctgttcgctgactggtttagatactacaaggagtatcaaaatttccagacattttacgatactgaaaactatcccctagttgagctggagaaaaagcaggccgacaggaagcgcaaaaccaagatctaccagcagaaaaagaatgatgtcttcacactcctgatggcaaaacacatctttaagtctgtgttcaagcaagactcaattgaccagtttagtcttgaagatttgtatcaaagccgagaggaacggctgggaaaccaggagcgtgctagacagaccggcgaaaggaatactaactacatctggaataaaacggtggacttaaagctctgtgatgggaaaattacagtcgagaacgttaagctgaaaaatgtgggagacttcataaagtatgagtacgatcagcgcgtgcaagccttccttaaatacgaagagaacatcgaatggcaggcgtttctgattaaggagtccaaggaagaggagaattatccttacgtagtcgaacgggagatcgaacagtatgagaaagtgagaagggaggaattgctcaaggaggttcatctgattgaagagtacatcctagaaaaagtgaaggacaaagagatactgaagaagggtgataaccagaatttcaaatattacatcctcaacggcctgcttaagcaattgaaaaatgaggacgtcgaatcttataaggtgtttaacctgaacaccgagccagaagatgttaatattaaccagttaaaacaggaggccactgacctcgaacagaaggctttcgtgctgacctacatcgcaaataagtttgccgctaaccaacttccgaaaaaggagttctgggattactgccaggagaaatatgggaagattgaaaaagagaagacatacgccgaatattttgcagaggtattcaagaaagaaaaggaggcgctgatcaaatga

SEQ ID NO: 11284 - RNA, 3384 nt, synthetic construct
  misc_feature 1..3384: note = Cas13b variant__Prevotella buccae__WP_004343973.1__Cas13b
  source 1..3384: mol_type = other RNA
atgcagaagcaagacaaactgttcgtggatagaaagaaaaacgccatctttgctttccccaagtacattaccataatggagaataaagaaaagcctgagccaatctattacgaactcacagacaagcacttttgggcagccttccttaacctggcgaggcataatgtctatactacgattaaccacatcaatcggcgcttggagattgctgaattaaaagatgacggctacatgatggggatcaagggaagctggaacgagcaggccaaaaagctggataaaaaggttcgactacgtgacctcataatgaagcattttccgttcctggaggcagccgcttatgaaatgaccaattccaaatctcccaacaataaggagcagagagaaaaagagcagtcagaggcacttagtctgaacaatttgaagaacgtgctctttatcttcctggaaaaactgcaagtactcaggaattactatagccactacaagtactccgaggaatctcctaaaccaatttttgagacatcgttactgaagaacatgtataaggtgttcgatgccaatgtccggcttgtgaaacgcgactacatgcatcacgaaaacatcgatatgcagagagactttactcacttgaacaggaagaaacaggttggtcggaccaagaatattatcgattcacccaacttccattatcactttgctgacaaagagggcaatatgacaatagccgggctgctattcttcgtgagcctctttctggataagaaggacgcgatttggatgcagaaaaagctgaaaggattcaaggacggccgcaaccttcgagagcaaatgaccaatgaagtcttttgcagaagtaggatctccttgcctaaactcaagctggagaacgtgcagactaaggattggatgcagttagacatgctgaatgaactcgtacggtgtccaaaatctctttacgagcgtctgcgcgaaaaggatagagagagcttcaaagttccctttgacattttctccgatgactataacgcagaggaggagccttttaagaatacattggtgaggcatcaggatcggttcccatactttgtcctacgatatttcgacctgaacgaaatctttgagcaactccgcttccagatcgatctgggtacctaccacttttcaatttacaataaaagaataggggacgaagatgaggtgaggcaccttacgcatcacctgtatggattcgcccggatccaggacttcgctccgcaaaaccagcccgaggaatggcgcaagttggtgaaggacctcgatcattttgagacaagtcaggaaccttacattagcaaaaccgccccacactatcatctggagaatgagaagatcggcataaaattctgctctgcacacaacaatttatttccctccctgcagacagacaagacttgtaacggcagatcaaaattcaacctagggacccaatttacagctgaagccttcctcagcgtccacgagctgcttcctatgatgttttactatttgctgctcaccaaggattacagtaggaaagaatctgcggacaaggttgagggaattatccgtaaggaaatctccaatatttatgccatctacgatgcattcgctaacaatgagattaacagcatagccgacctgacgcggcgacttcagaatactaacatcctgcagggtcatttgccaaaacagatgatttcgatcctcaagggcagacaaaaagatatggggaaggaggctgaaaggaaaatcggagagatgattgacgatacacagcgccggctggacttactgtgcaagcagaccaatcagaagataagaatcggcaaaaggaacgccggtctactcaagtctgggaaaattgcagattggctggtgaatgacatgatgcgctttcaacccgtacagaaggatcagaacaatatcccgattaacaattccaaagccaactcaactgaataccgaatgcttcagcgggctttggcgctgttcggaagtgagaattttcgtctcaaggcatatttcaaccaaatgaacctggtgggcaatgacaaccctcacccctttttagccgaaacacagtgggagcatcagaccaatatcctgagcttctacagaaactatcttgaggctaggaagaaatacttgaagggcctcaaaccacaaaattggaagcagtatcagcacttcctgatactaaaagtccagaagacgaaccgcaataccctggtgacagggtggaagaactcctttaatctccctcggggaatcttcactcaacccattagagaatggtttgagaaacacaacaattctaagaggatctacgaccagattctgagcttcgatcgagttggttttgtggccaaagcaatcccactttatttcgccgaagagtacaaggacaacgtccagcccttttacgattatcctttcaatataggcaaccgcttgaaaccaaagaaacggcagtttctggacaagaaggaaagagtggagttatggcagaaaaataaggaactcttcaaaaactacccgtcagaaaagaaaaagaccgatctggcttatcttgactttctgagttggaagaaattcgagagggaattgcgtctcattaagaaccaagatatcgtaacatggctgatgttcaaagagctatttaatatggccactgttgaggggctgaagattggagaaatccatctccgcgacatagataccaacacagcaaatgaggaatccaacaatatcctgaaccggattatgcccatgaaacttcctgtgaagacctacgagactgacaataagggcaacatcttgaaagaaagaccactggcgacgttctatattgaggagacagaaaccaaggtcttaaaacagggtaattttaaggctctcgtgaaagataggcgactgaacgggcttttcagctttgccgagactaccgacctgaatctagaggaacaccccatctctaagctctcagtcgatctggaattgataaagtaccagacaacccggattagtatcttcgagatgactctgggcttagagaaaaagctcatcgacaaatatagcacactgcctacggactcctttcgcaacatgcttgaaagatggctgcaatgtaaggcaaataggccagagttgaaaaactacgttaattctctcattgccgtgcggaacgctttctcgcataatcagtaccccatgtatgatgccaccctgtttgcagaagtgaagaagttcactctatttccgagcgtagacactaaaaagatcgagctgaacattgctcctcagcttctcgaaatagtcggaaaagccatcaaggagattgagaaatccgaaaacaagaattga

SEQ ID NO: 11285 - RNA, 3273 nt, synthetic construct
  misc_feature 1..3273: note = Cas13b variant__Prevotella sp.__WP_044065294__Cas13b
  source 1..3273: mol_type = other RNA
atgaacatccccgccctggtggagaatcagaagaaatacttcggcacctatagcgtcatggctatgctcaacgcacaaacagttcttgaccacattcagaaggtggccgatatagaaggggagcagaatgaaaacaatgagaacctgtggtttcatcctgtaatgtcccacttgtacaatgcgaaaaacggatatgacaagcagccagaaaagactatgttcatcattgagagattacaatcttactttccgttcctgaagatcatggctgagaatcagagggaatattcaaacggtaagtacaaacagaatcgggtggaggtcaacagtaatgatatttttgaagtgctaaagcgcgccttcggcgttctcaaaatgtatcgagacctgacgaaccattacaagacctacgaggagaaacttaatgatgggtgcgaatttctgacaagcactgagcagcccttgtccggaatgatcaacaactattacaccgtggcactccgtaatatgaacgaaagatatggctacaagacagaggacctggccttcatacaagataagaggtttaaattcgtcaaggacgcttatggtaaaaagaaatctcaggtgaataccgggtttttcctgtcgctccaggattacaacggagacactcagaagaaattacacctgtcaggcgtaggcatcgcacttttgatttgtctgtttctagataagcaatatatcaatattttcctcagccggctgcctatcttcagttcctacaacgcccagtctgaagaacgcagaataattatcaggagctttgggattaattccatcaaacttccaaaagaccggatccattcagagaagagtaacaaaagcgttgctatggatatgctgaatgaagtgaagcgctgccccgacgagttgttcacaaccctctctgccgaaaaacagtcccgatttagaattatatcagacgatcacaacgaggtcctgatgaagaggagcagtgaccggttcgtgcctttactgctccaatacatcgattatggaaaactttttgaccacattcgtttccatgtgaatatgggtaaactgcgctacttgctaaaggcggataaaacgtgtatcgacggccagactagagtcagggttatagaacagccactgaacgggtttggacggctcgaggaggcagaaaccatgcgaaagcaggagaatggcacattcggtaactctgggattcgcatcagagattttgaaaatatgaaaagggacgatgccaaccccgctaactatccttacatcgtggacacttatacccactacattctggagaataacaaggtagaaatgttcatcaatgataaggaggactccgccccacttctgccggtgattgaggacgatcggtatgtcgtgaaaacaatacccagctgccgcatgtcgaccttggaaatccctgcaatggcttttcatatgttcctctttggatctaagaaaacggagaagctgattgttgacgtgcacaacagatacaaaaggttattccaagccatgcagaaggaagaggtcactgcggagaatatcgcctccttcggcatcgcagaatcagatctgccacagaagattctagacctcataagtggcaacgctcacgggaaagatgtggacgcctttatccgtctgacagtagatgacatgcttaccgatactgagcggcgaattaagagattcaaagacgatcgcaagagcatcaggtccgctgacaataaaatgggaaagcggggttttaaacagatttctacaggcaagttggccgatttcctggcaaaggacatcgttctctttcaacccagcgtgaacgacggggaaaataaaataaccggactgaactacagaatcatgcagtcagccattgctgtctatgatagtggcgacgattacgaggcgaagcagcagttcaaacttatgtttgaaaaggcaaggctgatcggtaaagggacgaccgagcctcatccattcttgtataaggtgtttgcccgctccattcccgctaatgccgtcgagttctacgaacgatatctcatcgagcggaagttttacctgacaggcttaagcaacgaaataaagaagggaaatcgtgtggacgttccgttcattagaagggatcaaaacaaatggaagactcctgcaatgaaaaccctgggccgcatctattctgaggacctacccgtggaactcccacggcagatgtttgataatgagattaagtcacacctgaagagtcttcctcagatggaggggatcgacttcaacaacgccaatgtaacatacttgatagctgaatacatgaaaagagtcctggatgacgatttccagactttttatcaatggaacaggaattaccgatatatggacatgctcaagggagagtacgatcgcaaaggtagcctgcagcattgtttcacctccgtggaggagcgggaaggcttatggaaggagagagcctctaggacagagcgttatcgcaaacaggcatcgaacaagatccggagcaatagacaaatgaggaacgcgtcctcagaagagattgaaaccatcctggacaagcgacttagtaattctcggaacgagtaccagaaaagcgagaaggttattcgcagatatagggtgcaggacgctttgctctttctgctagccaaaaagactctgacggaactcgcagatttcgacggggagcggtttaaactgaaggaaatcatgcccgatgccgagaaaggaatactttccgaaattatgccaatgtcattcacatttgagaagggcggtaagaaatacaccatcactagcgaggggatgaagttgaaaaattacggcgacttctttgtcctggcttctgataagcgaatcggaaacttactcgaactggtgggctccgacattgtaagtaaagaggatatcatggaagagttcaataagtatgaccagtgcagacccgaaattagctctatagtgtttaaccttgagaagtgggccttcgatacctaccctgagctgtccgcacgcgttgacagggaagagaaagtcgatttcaagtcaatcttgaaaattctcctgaataacaagaatatcaacaaagaacaaagtgacattctacgtaagatccggaacgcttttgaccacaataactatccagataagggggtggtggagataaaagccctgccggaaatcgcgatgagcattaagaaagccttcggagagtacgctatcatgaagtga

SEQ ID NO: 11286 - RNA, 4152 nt, synthetic construct
  misc_feature 1..4152: note = Cas13b variant__Artificial____PspCas13b-GS-HsADAR2DD(E488Q,del984- 1090)
  source 1..4152: mol_type = other RNA
atgaacatccccgccctggtggagaatcagaagaaatacttcggcacctatagcgtcatggctatgctcaacgcacaaacagttcttgaccacattcagaaggtggccgatatagaaggggagcagaatgaaaacaatgagaacctgtggtttcatcctgtaatgtcccacttgtacaatgcgaaaaacggatatgacaagcagccagaaaagactatgttcatcattgagagattacaatcttactttccgttcctgaagatcatggctgagaatcagagggaatattcaaacggtaagtacaaacagaatcgggtggaggtcaacagtaatgatatttttgaagtgctaaagcgcgccttcggcgttctcaaaatgtatcgagacctgacgaacgcatacaagacctacgaggagaaacttaatgatgggtgcgaatttctgacaagcactgagcagcccttgtccggaatgatcaacaactattacaccgtggccctccgtaatatgaacgaaagatatggctacaagacagaggacctggctttcatacaagataagaggtttaaattcgtcaaggacgcatatggtaaaaagaaatctcaggtgaataccgggtttttcctgtcgctccaggattacaacggagacactcagaagaaattacatctgtcaggcgtaggcatcgcccttttgatttgtctgtttctagataagcaatatatcaatattttcctcagccggctgcctatcttcagttcctacaacgctcagtctgaagaacgcagaataattatcaggagctttgggattaattccatcaaacttccaaaagaccggatccactcagagaagagtaacaaaagcgttgccatggatatgctgaatgaagtgaagcgctgccccgacgagttgttcacaaccctctctgcggaaaaacagtcccgatttagaattatatcagacgatcataacgaggtcctgatgaagaggagcagtgaccggttcgtgcctttactgctccaatacatcgattatggaaaactttttgaccacattcgtttccacgtgaatatgggtaaactgcgctacttgctaaaggcagataaaacgtgtatcgacggccagactagagtcagggttatagaacagccactgaacgggtttggacggctcgaggaggccgaaaccatgcgaaagcaggagaatggcacattcggtaactctgggattcgcatcagagattttgaaaatatgaaaagggacgatgctaaccccgccaactatccttacatcgtggacacttatacccattacattctggagaataacaaggtagaaatgttcatcaatgataaggaggactccgcaccacttctgccggtgattgaggacgatcggtatgtcgtgaaaacaatacccagctgccgcatgtcgaccttggaaatccctgctatggcctttcacatgttcctctttggatctaagaaaacggagaagctgattgttgacgtgcataacagatacaaaaggttattccaagcgatgcagaaggaagaggtcactgccgagaatatcgcatccttcggcatcgctgaatcagatctgccacagaagattctagacctcataagtggcaacgcccacgggaaagatgtggacgcttttatccgtctgacagtagatgacatgcttaccgatactgagcggcgaattaagagattcaaagacgatcgcaagagcatcaggtccgccgacaataaaatgggaaagcggggttttaaacagatttctacaggcaagttggcagatttcctggccaaggacatcgttctctttcaacccagcgtgaacgacggggaaaataaaataaccggactgaactacagaatcatgcagtcagctattgcggtctatgatagtggcgacgattacgaggcaaagcagcagttcaaacttatgtttgaaaaggccaggctgatcggtaaagggacgaccgagcctcacccattcttgtataaggtgtttgctcgctccattcccgccaatgcagtcgagttctacgaacgatatctcatcgagcggaagttttacctgacaggcttaagcaacgaaattaaaaagggaaatcgtgtggacgttccgttcattagaagggatcaaaacaaatggaagactcctgccatgaaaaccctgggccgcatctattctgaggacctacccgtggaactcccacggcagatgtttgataatgagattaagtcacatctgaagagtcttcctcagatggaggggatcgacttcaacaacgctaatgtaacatacttgatagccgaatacatgaaaagagtcctggatgacgatttccagactttttatcaatggaacaggaattaccgatatatggacatgctcaagggagagtacgatcgcaaaggtagcctgcagcactgtttcacctccgtggaggagcgggaaggcttatggaaggagagagcatctaggacagagcgttatcgcaaacaggcgtcgaacaagatccggagcaatagacaaatgaggaacgcttcctcagaagagattgaaaccatcctggacaagcgacttagtaattctcggaacgagtaccagaaaagcgagaaggttattcgcagatatagggtgcaggacgccttgctctttctgctagcaaagaagactctgacggaactcgccgatttcgacggggagcggtttaaactgaaggaaatcatgcccgatgctgagaaaggaatactttccgaaattatgccaatgtcattcacatttgagaagggcggtaagaaatacaccatcactagcgaggggatgaagttgaaaaattacggcgacttctttgtcctggcctctgataagcgaatcggaaacttactcgaactggtgggctccgacattgtaagtaaagaggatgggagccttcagctgccccctttggaaagactcaccctgggatctcaactacatctgccacaggtgctcgcagacgctgtttcccgcctggtccttggtaagttcggcgatttgacagacaatttttcaagtccgcacgccaggcgtaaggtgctggcgggggtggtcatgaccactggaacagatgttaaagacgccaaggtgatcagcgtgtcgacgggcaccaaatgcattaacggtgagtatatgtccgaccgggggttagctctcaatgattgtcatgcagaaataatctctagaaggagcctgcttcgcttcctgtacactcagctagagctctatctgaacaataaggacgatcagaaacgatcaattttccaaaagagtgagagaggcggatttcggttgaaggaaaacgtacagttccacctgtacatctccacatctccctgcggcgacgccaggatttttagccctcacgagccaatcttagaggaacccgctgatcgccatcctaaccgtaaagccagagggcagctccggaccaagatagaatccggacagggcacaatcccagtcaggtcaaatgcaagcattcaaacttgggacggtgtgctgcagggggagcgccttctgaccatgagttgttctgataaaatcgcgcgatggaacgttgtgggaatacagggctccttgctcagcatcttcgtcgagcccatatatttttcgtcaattatcctgggttctctataccacggcgaccatctgagtagagccatgtatcaacggatctccaatattgaagatcttccgcctctctacacgctgaacaagccattgctgagcgggatatctaatgctgaggccaggcagcccggaaaagcacctaacttcagcgtgaattggaccgttggcgactccgctatcgaagtgattaacgccacaactgggaaggatgagttaggacgcgcatcaagactctgcaagcacgccctgtactgtaggtggatgcgggtacacggcaaagtccccagtcatcttctgcgtagcaagatcaccaaaccaaatgtgtatcacgagtctaagttggctgcgaaagaataccaggccgcaaaggctcgcctctttacagccttcattaaggccggtctgggggcttgggtggagaaacctactgaacaggaccaattttccctaacctga

SEQ ID NO: 11287 - RNA, 4152 nt, synthetic construct
  misc_feature 1..4152: note = Cas13b variant__Artificial____PspCas13b-GS-HsADAR2DD(E488Q,T375G,d el984- 1090)
  source 1..4152: mol_type = other RNA
atgaacatccccgccctggtggagaatcagaagaaatacttcggcacctatagcgtcatggctatgctcaacgcacaaacagttcttgaccacattcagaaggtggccgatatagaaggggagcagaatgaaaacaatgagaacctgtggtttcatcctgtaatgtcccacttgtacaatgcgaaaaacggatatgacaagcagccagaaaagactatgttcatcattgagagattacaatcttactttccgttcctgaagatcatggctgagaatcagagggaatattcaaacggtaagtacaaacagaatcgggtggaggtcaacagtaatgatatttttgaagtgctaaagcgcgccttcggcgttctcaaaatgtatcgagacctgacgaacgcatacaagacctacgaggagaaacttaatgatgggtgcgaatttctgacaagcactgagcagcccttgtccggaatgatcaacaactattacaccgtggccctccgtaatatgaacgaaagatatggctacaagacagaggacctggctttcatacaagataagaggtttaaattcgtcaaggacgcatatggtaaaaagaaatctcaggtgaataccgggtttttcctgtcgctccaggattacaacggagacactcagaagaaattacatctgtcaggcgtaggcatcgcccttttgatttgtctgtttctagataagcaatatatcaatattttcctcagccggctgcctatcttcagttcctacaacgctcagtctgaagaacgcagaataattatcaggagctttgggattaattccatcaaacttccaaaagaccggatccactcagagaagagtaacaaaagcgttgccatggatatgctgaatgaagtgaagcgctgccccgacgagttgttcacaaccctctctgcggaaaaacagtcccgatttagaattatatcagacgatcataacgaggtcctgatgaagaggagcagtgaccggttcgtgcctttactgctccaatacatcgattatggaaaactttttgaccacattcgtttccacgtgaatatgggtaaactgcgctacttgctaaaggcagataaaacgtgtatcgacggccagactagagtcagggttatagaacagccactgaacgggtttggacggctcgaggaggccgaaaccatgcgaaagcaggagaatggcacattcggtaactctgggattcgcatcagagattttgaaaatatgaaaagggacgatgctaaccccgccaactatccttacatcgtggacacttatacccattacattctggagaataacaaggtagaaatgttcatcaatgataaggaggactccgcaccacttctgccggtgattgaggacgatcggtatgtcgtgaaaacaatacccagctgccgcatgtcgaccttggaaatccctgctatggcctttcacatgttcctctttggatctaagaaaacggagaagctgattgttgacgtgcataacagatacaaaaggttattccaagcgatgcagaaggaagaggtcactgccgagaatatcgcatccttcggcatcgctgaatcagatctgccacagaagattctagacctcataagtggcaacgcccacgggaaagatgtggacgcttttatccgtctgacagtagatgacatgcttaccgatactgagcggcgaattaagagattcaaagacgataggaaaagcatccgctccgccgacaataaaatgggaaagcggggttttaaacagatttctacaggcaagttggcagatttcctggccaaggacatcgttctctttcaacccagcgtgaacgacggggaaaataaaataaccggactgaactacagaatcatgcagtcagctattgcggtctatgatagtggcgacgattacgaggcaaagcagcagttcaaacttatgtttgaaaaggccaggctgatcggtaaagggacgaccgagcctcacccattcttgtataaggtgtttgctcgctccattcccgccaatgcagtcgagttctacgaacgatatctcatcgagcggaagttttacctgacaggcttaagcaacgaaataaagaagggaaatcgtgtggacgttccgttcattagaagggatcaaaacaaatggaagactcctgccatgaaaaccctgggccgcatctattctgaggacctacccgtggaactcccacggcagatgtttgataatgagattaagtcacatctgaagagtcttcctcagatggaggggatcgacttcaacaacgctaatgtaacatacttgatagccgaatacatgaaaagagtcctggatgacgatttccagactttttatcaatggaacaggaattaccgatatatggacatgctcaagggagagtacgatcgcaaaggtagcctgcagcactgtttcacctccgtggaggagcgggaaggcttatggaaggagagagcatctaggacagagcgttatcgcaaacaggcgtcgaacaagatccggagcaatagacaaatgaggaacgcttcctcagaagagattgaaaccatcctggacaagcgacttagtaattctcggaacgagtaccagaaaagcgagaaggttattcgcagatatagggtgcaggacgccttgctctttctgctagcaaagaagactctgacggaactcgccgatttcgacggggagcggtttaaactgaaggaaatcatgcccgatgctgagaaaggaatactttccgaaattatgccaatgtcattcacatttgagaagggcggtaagaaatacaccatcactagcgaggggatgaagttgaaaaattacggcgacttctttgtcctggcctctgataagcgaatcggaaacttactcgaactggtgggctccgacattgtaagtaaagaggatgggagccttcagctgccccctttggaaagactcaccctgggatctcaactacatctgccacaggtgctcgcagacgctgtttcccgcctggtccttggtaagttcggcgatttgacagacaatttttcaagtccgcacgccaggcgtaaggtgctggcgggggtggtcatgaccactggaacagatgttaaagacgccaaggtgatcagcgtgtcgacgggcggtaaatgcattaacggggagtatatgtccgaccggggcttagctctcaatgattgtcatgcagaaataatctctagaaggagcctgcttcgcttcctgtacacccagctagagctctatctgaacaataaggacgatcagaaacgatcaattttccaaaagagtgagagaggaggctttcggttgaaggaaaacgtacagttccacctgtacatctccacttctccctgcggggacgccaggatttttagccctcacgagccaatcttagaggaacccgctgatcgccatcctaaccgtaaagccagaggacagctccggacaaagatagaatccggccagggtaccatcccagtcaggtcaaatgcaagcattcaaacatgggacggggtgctgcagggagagcgccttctgactatgagttgttctgataaaatcgcgcgatggaacgttgtgggcattcagggttccttgctcagcatcttcgtcgagcccatatatttttcgtcaattatcctgggctctctataccacggggaccatctgagtagagccatgtatcaacggatctccaatattgaagatcttccgcctctctacaccctgaacaagccattgctgagcggaatatctaatgctgaggccaggcagcccggcaaagcacctaacttcagcgtgaattggacggttggggactccgctatcgaagtgattaacgccaccacaggaaaggatgagttaggccgcgcatcaagactctgcaagcacgccctgtactgtaggtggatgcgggtacacggtaaagtccccagtcatcttctgcgtagcaagatcactaaaccaaatgtgtatcacgagtctaagttggctgcgaaagaataccaggccgcaaaggctcgcctctttaccgccttcattaaggccgggctgggagcttgggtggagaaacctacagaacaggaccaattttccctaacttga

SEQ ID NO: 11288 - RNA, 2862 nt, synthetic construct
  misc_feature 1..2862: note = Cas13b variant__Alistipes sp.__WP_047447901.1__Cas13b
  source 1..2862: mol_type = other RNA
atgagcaacgagatcggcgccttcagagaacaccagtttgcttacgcacccgggaatgagaagcaagaagaggccaccttcgcgacatattttaacctggctctctccaatgtggaaggaatgatgttcggtgaggtcgagtctaaccctgacaaaattgaaaagtcacttgatactctgccaccggccatattgaggcagatcgcaagttttatttggttaagcaaagaggaccatcccgataaggcctactccacggaagaggttaaagtgatcgtaaccgacctggtgcggcgcctatgcttctatcgaaattacttttctcactgtttctatctcgatacacagtacttttattcggacgagctggtcgatactaccgctattggcgaaaagctgccttacaacttccatcactttatcacaaatcgtctgttcagatactcattgccagagataaccctctttaggtggaacgaaggggagcggaagtatgaaatcctgcgcgacggactgattttcttctgctgtctctttttaaaaagaggccaggcagagaggttcctgaatgagcttcggtttttcaagcgcactgatgaagagggtcgaatcaaaagaacaatttttaccaagtactgcacgagggaaagccataaacacatcgggatagaggaacaagacttcttgatttttcaggatatcattggagacctgaaccgggtgcccaaggtttgtgatggcgtggtcgacctaagtaaggagaatgagcgttatatcaaaaaccgcgaaacttccaatgagtctgacgaaaacaaggccagatacaggctcctgatccgggagaaagataagttcccttattaccttatgcgatatattgtggactttggcgtactgccatgcataaccttcaaacagaatgattacagcacaaaggaagggcgcggacagtttcactaccaagacgctgccgttgcgcaggaggagagatgttataacttcgtggtcaggaacggtaatgtgtactattcctacatgccccaggcacagaacgtggtccggatctcagaattgcaaggcactattagtgttgaggaactccgcaatatggtgtatgccagcatcaacgggaaagatgtaaataagtctgtggagcagtacctgtatcatttacaccttctctacgagaagatacttaccatttccggacagacaatcaaagaaggcagagtcgacgtggaggattacaggcctctgttggacaagctactgctccgtccagcttcaaacggtgaagaactgcggcgagaacttagaaaactgttgccgaagagggtttgcgatctcctgagcaatcgctttgactgtagtgagggggtgtctgccgtcgagaaacggttaaaggcaatcctgctaagacatgaacaactcctgctttcccagaaccccgctttgcacattgataagatcaaaagcgtgattgactatctgtacctcttcttctcggacgatgagaagtttaggcagcagcctaccgaaaaagcccaccgcggactgaaggacgaggagttccaaatgtatcattaccttgtaggcgattatgactctcacccactggcgttgtggaaagagctcgaggcctccggccgactgaagcccgaaatgcggaagttaacgtcagcaacaagtctgcatgggctatacatgctctgcctgaaaggaactgttgagtggtgtcgtaagcagcttatgagcataggtaaaggcaccgctaaggtggaagccatcgctgatagagtcgggttgaaactgtatgacaagctcaaggagtacactcctgaacagctggagagggaggtgaaattagtcgtgatgcacggatacgccgcagccgctacaccaaagcccaaagcgcaggcagccattccgtccaagctgaccgaacttcgcttttattctttcttgggcaaacgggagatgagctttgctgccttcatcagacaagataagaaagcacagaagctctggctgaggaatttttacacggttgaaaacatcaagaccctacagaaacgacaggccgctgccgacgcagcgtgcaagaaactgtataatctcgtgggtgaggtagagcgcgtccatacaaacgataaggtgctggttcttgtggctcaacggtacagagaaaggttgctgaatgtcgggtcaaaatgcgccgtgactttagacaaccctgagcgtcagcagaagctcgcagatgtatatgaagtgcagaatgcctggctgagtattcgcttcgacgatcttgactttaccctgacacacgttaacttgtccaacctccggaaggcttacaatctgatacccagaaaacacatcctagccttcaaggagtatctggacaacagggtcaaacaaaagctctgtgaagagtgccgaaatgtgcggcgcaaagaggatctgtgtacttgctgtagcccaagatactctaaccttacctcatggttgaaggaaaatcatagtgagagctccattgaaagggaggcagctacaatgatgctgttagacgtggaacggaagctcctgtcttttcttctggatgagcgaagaaaagccatcattgagtacggcaagttcatccctttttcggcgctagtcaaagaatgccgcctcgccgacgctggactgtgtggcataaggaacgatgttttgcacgacaatgtgatcagctatgcagatgccattgggaagctgtccgcttacttccccaaagaggcctcagaagcagtggagtatatccgtcggaccaaggaagtaagagagcagaggcgcgaggaattaatggcgaacagttctcagtga

SEQ ID NO: 11289 - RNA, 3348 nt, synthetic construct
  misc_feature 1..3348: note = Cas13b variant__Bacteroides pyogenes__ERI81700.1__Cas13b
  source 1..3348: mol_type = other RNA
atggagagcatcaagaactcccagaaatctaccggcaagacactgcaaaaagatcccccttacttcgggctctatcttaatatggccctgttgaacgtgagaaaggtcgaaaatcacattaggaaatggttaggagacgttgctctgctaccagagaagtcaggttttcatagtctcctgactacggacaaccttagctccgcaaagtggacccggttctactataaatctcgcaagtttctgccgttcttggaaatgtttgattcggacaaaaagtcatacgagaatcgacgtgaaacaactgagtgcctcgataccatagacagacagaaaatcagcagtctgctgaaggaggtgtatggcaagctccaggatattaggaacgccttctcccactaccatatcgacgatcagtctgtaaaacacacagcgttaattatcagctccgaaatgcatcggtttatagagaatgcttattcattcgccctgcaaaagacccgcgcaagatttactggggtgttcgtcgaaacagactttcttcaggccgaggagaaaggagataacaagaaattctttgctatcggcggtaatgaagggattaagttgaaagacaacgcactgatcttcctaatttgtctcttcctggatagggaggaagcctttaagttccttagtcgggctaccggatttaagagcacgaaagagaagggcttcctggccgtgcgcgaaactttttgcgcgttgtgttgccgacagccccacgagagactcctgtctgttaatcctagggaggcattactgatggacatgctcaacgaacttaatcggtgtccagacatcctgttcgagatgttggatgaaaaagaccagaagtcctttctacccctgctcggcgaggaagaacaagcccacatactggagaactcacttaatgatgaactgtgcgaggctattgacgatcctttcgaaatgatcgccagcttgagtaaacgtgtgcgctacaagaacagatttccatacctcatgctgaggtatattgaggaaaagaacttactgcccttcatccggtttcgaatcgacctagggtgtctcgagctggcatcttaccctaaaaagatgggagaggaaaataactatgagcgctccgtcaccgatcatgctatggccttcggtagacttacagactttcacaatgaagatgcggtgttgcagcagattactaaaggcataaccgacgaggtaaggttcagcctgtacgccccacggtatgcaatctacaacaataagattgggttcgttcgcacaggaggctcggataaaatctcttttccgaccctcaagaagaaaggtggggagggacattgcgtggcttatacgctgcagaacactaagtccttcggctttatatcaatttacgaccttagaaaaatcctgttgctcagtttcctggacaaggataaagccaagaatatcgtcagcggcttactggaacaatgtgagaagcactggaaagacctatccgaaaacctctttgatgctattaggacagagctgcagaaggagttccccgtgcctcttatccgttacaccttgccacggtctaaagggggaaagctggtgagctcaaaactcgccgacaagcaggagaaatatgagagtgaatttgagcgaagaaaggaaaagctgactgagattttatccgaaaaagatttcgacctgagccaaatacccaggcgcatgatcgatgagtggcttaatgtcttgcctacatctcgggagaagaaactcaagggttacgttgaaaccctgaaactagactgcagagagaggctgcgcgtgtttgaaaagcgagagaagggcgaacacccagtacccccgcggattggggagatggcaacggatctcgccaaagacatcatccgtatggtgattgatcagggagtcaagcagagaataacctcagcttattacagtgagatccagaggtgtctggcgcaatatgcaggcgacgataaccgccggcatcttgacagcattatcagagaattgaggctgaaagacacaaagaatggtcaccctttcttagggaaagtgctccgacccggcctgggacatactgagaaactttaccagcgctattttgaagagaagaaagagtggctggaagccaccttctacccagctgcctcccctaagcgggttcccagatttgtgaacccacccacaggcaaacagaaggagttgcctctcattatcaggaatctgatgaaagaacgtccagagtggcgcgattggaagcagcggaagaactctcacccgatagacctaccctcgcaactgttcgaaaatgagatctgcagactcctgaaagataagattgggaaagagcctagcggaaaacttaaatggaacgaaatgttcaagttgtactgggacaaagagtttccaaacggtatgcagaggttctatcgatgcaagcggcgcgtcgaagtgtttgataaggtagttgagtacgaatattccgaggagggcgggaattacaaaaagtattacgaagcactgatcgacgaggtggtcagacagaaaatttcaagttctaaggaaaagagcaagttacaggtggaggatctcactctgtccgtcaggcgggtgttcaagcgagccatcaacgaaaaagagtatcaacttagactgctatgtgaggacgatcgcctcctgtttatggctgttagggacttgtacgattggaaggaagcccagctggacttagataaaatagacaatatgctcggagagcccgtgtcagtaagccaggtcattcagctggaaggcggtcaacctgacgcagtgatcaaggcggagtgcaaacttaaggatgtttctaagctgatgcgttactgttatgacgggcgggtgaaaggcttgatgccatacttcgctaaccatgaggccacccaggaacaggtcgagatggaactcagacactatgaggatcacaggcgccgagtgtttaattgggtattcgcactggaaaagtccgtgctaaagaacgagaagctgagacggttttacgaggaaagtcaaggaggctgcgagcataggcgctgtattgacgcccttcgtaaagctagcctcgtttctgaagaggaatatgagttcctggtccacatcagaaataagtccgcccataaccagtttcccgatttggagatagggaagctgccgcctaatgtgacatcaggattctgcgaatgtatctggagtaaatacaaggcaattatctgccggattatcccattcatagaccccgagaggcgctttttcggtaaattactcgaacagaagtga

SEQ ID NO: 11290 - RNA, 3348 nt, synthetic construct
  misc_feature 1..3348: note = Cas13b variant__Bacteroides pyogenes__WP_034542281.1__Cas13b
  source 1..3348: mol_type = other RNA
atggagagcatcaagaactcccagaaatctaccggcaagacactgcaaaaagatcccccttacttcgggctctatcttaatatggccctgttgaacgtgagaaaggtcgaaaatcacattaggaaatggttaggagacgttgctctgctaccagagaagtcaggttttcatagtctcctgactacggacaaccttagctccgcaaagtggacccggttctactataaatctcgcaagtttctgccgttcttggaaatgtttgattcggacaaaaagtcatacgagaatcgacgtgaaacagccgagtgcctcgatactatagacagacagaaaatcagcagtctgctgaaggaggtgtatggcaagctccaggatattaggaacgcgttctcccactaccatatcgacgatcagtctgtaaaacacaccgctttaattatcagctccgaaatgcatcggtttatagagaatgcctattcattcgcactgcaaaagacacgcgccagatttaccggggtgttcgtcgaaactgactttcttcaggctgaggagaaaggagataacaagaaattctttgcaatcggcggtaatgaagggattaagttgaaagacaacgccctgatcttcctaatttgtctcttcctggatagggaggaagcatttaagttccttagtcgggccacaggatttaagagcaccaaagagaagggcttcctggcggtgcgcgaaacgttttgcgcattgtgttgccgacagccccacgagagactcctgtctgttaatcctagggaggccttactgatggacatgctcaacgaacttaatcggtgtccagacatcctgttcgagatgttggatgaaaaagaccagaagtcctttctacccctgctcggcgaggaagaacaagctcacatactggagaactcacttaatgatgaactgtgcgaggccattgacgatcctttcgaaatgatcgctagcttgagtaaacgtgtgcgctacaagaacagatttccatacctcatgctgaggtatattgaggaaaagaacttactgcccttcatccggtttcgaatcgacctagggtgtctcgagctggcttcttaccctaaaaagatgggagaggaaaataactatgagcgctccgtcactgatcatgccatggcgttcggtagacttaccgactttcacaatgaagatgccgtgttgcagcagattacaaaaggcataactgacgaggtaaggttcagcctgtacgcaccacggtatgctatctacaacaataagattgggttcgttcgcacctcgggatctgataaaatctcctttccgacactcaagaagaaaggcggtgaggggcattgcgtggcctataccctgcagaacacgaagtcattcggatttataagtatttacgaccttagaaaaatcctgttgctcagcttcctggacaaggataaagctaagaatatcgtctccggcttactggaacaatgtgagaagcactggaaagacctatctgaaaacctctttgatgccattaggactgagctgcagaaggagttccccgtgcctcttatccgttacacattgccacggagcaaaggcgggaagctggtgtcaagtaaactcgcagacaagcaggagaaatatgagtccgaatttgagcgaagaaaggaaaagctgaccgagattttaagcgaaaaagatttcgacctgtctcaaatacccaggcgcatgatcgatgagtggcttaatgtcttgcctacttcacgggagaagaaactcaagggatacgttgaaacactgaaactagactgcagagagaggctgcgcgtgtttgaaaagcgagagaagggtgaacacccacttcccccgcggattggcgagatggccaccgatctggctaaagacatcatccgtatggtaattgatcagggggtgaagcagagaataacgagtgcgtattacagcgagatccagaggtgtcttgcacaatatgccggagacgataaccgccggcatttggactccattatcagagaactgaggttaaaagacaccaagaatggccaccctttcctcggtaaagtcctgcgacccgggcttggccatacagagaagctgtaccagcgctattttgaagagaagaaagagtggttggaagctactttctacccagccgcatctcctaagcgggtgcccagatttgttaacccacccaccggaaaacagaaggagctccctctgattatcaggaatctaatgaaagaacgtccagagtggcgcgattggaagcagcggaagaactcgcacccgatagacctgcccagccaactcttcgaaaatgagatctgcagactgcttaaagataagattggcaaagagccttccgggaagttgaaatggaacgaaatgttcaagctgtactgggacaaagagtttccaaacggaatgcagaggttctatcgatgcaagcggcgcgtggaagtctttgataaggtggtagagtacgaatattcagaggagggtggcaattacaaaaagtattacgaagccttaatcgacgaggttgtgagacagaaaattagttctagcaaggaaaaatccaagctccaggtcgaggatctgacactttcagtgaggcgggtcttcaagcgagctatcaacgaaaaagagtatcaactgagactactctgtgaggacgatcgcctgttgtttatggccgtgagggacctgtacgattggaaggaagcacagttagacctcgataaaatagacaatatgctgggggagcccgttagcgtgtctcaggtaattcagcttgaaggaggccaacctgacgcggtcatcaaggctgagtgcaaactgaaggatgtgtccaagttgatgcgttactgttatgacggtcgggttaaagggctcatgccatacttcgccaaccatgaggcaactcaggaacaggtggagatggaactgagacactatgaggatcacaggcgccgagtctttaattgggtgttcgccctagaaaagagtgtactgaaaaacgagaagctcagacggttttacgaggaaagccaaggcggatgcgagcataggcgctgtattgacgctctccgtaaagcctctctggtgtccgaagaggaatatgagttcttggttcacatcagaaataagtcagcacataaccagtttcccgatctggagataggcaagttaccgcctaatgtcaccagtgggttctgcgaatgtatctggagcaaatacaaggctattatctgccggattatcccattcatagaccccgagaggcgctttttcggaaaactcctggaacagaagtga

SEQ ID NO: 11291 - RNA, 3675 nt, synthetic construct; identical to SEQ ID NO: 11282
  misc_feature 1..3675: note = Cas13b variant__Bergeyella zoohelcum__WP_002664492.1__Cas13b
  source 1..3675: mol_type = other RNA

SEQ ID NO: 11292 - RNA, 3600 nt, synthetic construct
  misc_feature 1..3600: note = Cas13b variant__Capnocytophaga canimorsus__WP_013997271.1__Cas13b
  source 1..3600: mol_type = other RNA
atgaagaacatccagagactgggcaaagggaatgagttcagcccctttaagaaagaagacaagttctactttggaggtttcctcaaccttgccaataacaatattgaggactttttcaaagaaataatcaccaggtttggcattgtgatcacagatgagaacaagaagcctaaagaaactttcggggagaagattctgaatgagatctttaaaaaggatatatccatcgtcgactatgaaaaatgggttaacattttcgctgattactttccattcacgaagtatttgtctttatacctggaggaaatgcaatttaagaatcgggtgatctgcttccgcgacgtaatgaaagagctactcaagaccgtggaggcactgcgaaacttctatacacactacgatcatgaaccgattaaaatcgaggaccgtgtcttttatttccttgataaggtgctgttggacgtttcactcactgtgaaaaataagtacctgaaaaccgataagacaaaggaatttctgaaccagcacataggagaggaactcaaagagttatgtaagcagagaaaagactacctggtcggcaagggtaaaaggattgataaggagagtgaaatcattaatgggatctataacaatgccttcaaggactttatctgcaaacgggagaagcaggacgataaagaaaaccataacagcgtggagaagattctttgtaataaagaaccccaaaacaagaagcagaaatcctctgcgaccgtatgggagttgtgctcgaagtcaagcagtaaatacactgagaagtccttccctaatcgcgaaaacgacaaacactgtctggaggttccaatatctcagaagggaatcgtgtttctactcagcttctttctgaataagggcgaaatttatgctcttacatccaacatcaaaggcttcaaggccaaaataaccaaggaggaacccgtcacgtacgataaaaattcaattagatatatggcaactcataggatgtttagtttcctggcctacaaggggttgaaacggaagatccgcaccagcgagatcaactataatgaggacggacaggcttcttccacatacgaaaaggagactctcatgctgcaaatgttagatgaactgaacaaagtgcctgacgtggtctaccagaatctctcagaggatgttcagaagacctttattgaggactggaacgaatatcttaaagagaataacggtgatgtgggcacaatggaagaggaacaggtaatccacccagtgattcgaaagagatacgaggacaaattcaattatttcgcaataaggtttctggatgagttcgcccaatttcccaccttgcggttccaggtccacctagggaactacctgtgcgacaagcgtacgaagcagatctgtgacactacaaccgaacgcgaggtgaaaaagaaaattactgtttttggaagactcagcgaactggagaacaagaaagctatcttccttaatgaaagggaggagatcaagggctgggaagtgtttcctaacccaagttatgatttcccgaaggagaatatttctgtcaactacaaagactttcccatagtgggttccatcctggatcgggaaaagcaacctgtaagcaataaaattgggatccgagttaagattgccgacgagttgcagcgcgaaatcgataaagcgataaaggagaagaaactcagaaacccaaagaataggaaagcaaaccaggacgagaagcagaaagaacggctggtgaatgagatcgtctcgacaaactctaatgaacaaggagagcccgtggtcttcattggccagcctaccgcctatttatccatgaacgatatccattcagtgctgtacgagtttctaattaataagatcagtggcgaagctctcgagacgaaaatagttgaaaagattgagacccagatcaagcagattatcgggaaagacgccacaactaagatactgaaaccatacaccaacgcaaatagcaactccatcaaccgcgaaaaacttttgagagatctggagcaagagcagcagattctcaagacactgcttgaagaacagcaacagagggaaaaggacaagaaagataagaaatctaagcgtaaacacgagctgtatcccagcgaaaagggaaaggtggctgtatggttggccaatgacatcaaacggttcatgccgaaggcgtttaaagagcagtggcgaggttaccatcactcactcctgcagaagtatttagcctactatgagcaaagtaaagaggagctgaagaacctactccctaaggaagtcttcaaacacttcccctttaagctgaaaggctacttccagcagcaatatcttaatcagttttacactgattacttgaagagaaggctgtcctatgtgaacgagctcctgttaaatattcagaacttcaaaaatgacaaggacgcactgaaggctaccgaaaaagagtgctttaagttctttcgcaaacagaactacatcataaatccaattaacatccaaatccagagcattcttgtttatcctatcttcttgaagcgggggtttctcgatgagaaacccacaatgattgacagagaaaagttcaaagagaataaggataccgaactggccgactggtttatgcattacaagaactataaagaggataattaccagaagttctatgcttacccactagagaaagtggaagagaaggaaaaattcaagaggaacaagcagataaataaacaaaagaaaaacgacgtctacactctgatgatggtggagtatatcattcagaagatctttggagataaattcgtagaagagaaccccctcgtgctgaagggcatttttcagtctaaggccgagcgccagcaaaataacacgcacgcagccacaacccaggaacgaaatcttaacggtatcttgaatcagcctaaagacataaagatccaagggaaaattactgttaagggcgtcaaactgaaggatatcggaaacttccggaagtacgagattgaccagcgtgtgaatacctttttagattatgaaccaagaaaagagtggatggcttacctcccgaacgactggaaggaaaaagagaagcagggccagctgccccctaataacgtgatcgataggcaaatatcaaaatatgagacagtccgcagtaagattcttctgaaagacgttcaggaattggagaagatcatcagcgacgaaattaaggaggaacatcggcacgatctcaaacaggggaagtactataatttcaaatactacatactgaacggactactgagacagctcaagaatgagaacgtggagaattataaagtgtttaagctgaacaccaatccagaaaaggtaaacatcactcaacttaaacaggaggcgacagacttggaacagaaggcattcgtcctgacgtacattaggaacaaatttgcccataatcagttacccaagaaagagttctgggattattgtcaagagaagtacggtaagatcgaaaaagagaagacctatgctgaatactttgccgaggtgttcaaacgagaaaaggaggcactcattaaatga

SEQ ID NO: 11293 - RNA, 3657 nt, synthetic construct
  misc_feature 1..3657: note = Cas13b variant__Capnocytophaga cynodegmi__WP_041989581.1__Cas13b
  source 1..3657: mol_type = other RNA
atggagaacaagaccagcctgggcaataacatctactataatcccttcaaacctcaggacaagtcctactttgccgggtatctcaacgctgcaatggaaaatattgattctgtgttcagagagcttggaaaaaggctgaagggtaaagaatacacatcagagaactttttcgacgccatatttaaggaaaatatcagtttggtcgagtatgagcggtacgttaagttactgagcgattatttcccaatggcgcgcctactcgacaaaaaggaagtgccgattaaagagcgaaaggaaaactttaaaaagaatttccgtggcatcattaaggctgtaagagatctgaggaacttttacactcacaaagagcatggggaggtggaaatcacggacgagatattcggagtccttgatgaaatgctgaagtccaccgtgttgacagttaaaaagaaaaagatcaaaactgacaagaccaaggagattctcaaaaagtctatcgaaaaacaactggatattctgtgccagaagaaactcgagtacttaaaggacacagcccggaagatcgaggaaaaacgcagaaatcagagggagcggggcgaaaagaaactggtgccccgctttgagtattcggatcgaagagacgatcttatagcagccatttacaacgacgctttcgacgtctatatcgataagaaaaaggactcattgaaggaaagcagtaaaaccaagtacaatactgagtcctatcctcagcaagaggaaggtgatctgaaaattccaatctctaagaacggggtggtatttctactcagcctgttcctttccaaacaggaggttcacgcattcaagtcaaagatcgccggatttaaagctacagtgattgacgaagccaccgtcagtcataggaagaatagcatatgtttcatggcgacgcacgagatcttttctcatctggcatacaaaaagttgaaacggaaggtgcgtactgccgaaattaactattccgaggctgagaacgccgaacagctctcaatctacgcaaaagagaccctgatgatgcagatgttagatgaactgagcaaggtgcccgacgtcgtttaccaaaatctcagtgaggatgtgcagaagacattcatagaggactggaacgaatatcttaaagagaataacggcgatgtaggcactatggaagaggaacaggtgattcaccctgtcatccgcaagagatacgaggacaaatttaattatttcgctatcaggtttctggatgagttcgcccagtttccaaccttgcggttccaagtgcacctagggaactacctgcatgactctcgacccaaggaacacctcatttccgaccgcagaatcaaagagaagattacagtttttggaaggctgagcgaacttgagcataagaaagcgctgttcataaagaataccgaaacgaacgaggatcggaaacactattgggaggtgtttcctaatccaaactacgacttcccgaaggaaaatatctcggtcaacgataaagacttccccattgccggttctatcttggatcgcgagaagcagcctactgcaggcaagatcgggattaaagtgaatctcctgaaccagaagtatatatccgaagtagacaaagctgttaaggcccaccaattaaaacagagaaataacaagccatcaatccagaacattatcgaggaaattgtgcccatcaatggaagtaaccctaaggagataatcgtctttggcggtcagccaacagcttacctgagcatgaatgatattcattccatcctatacgagttctttgacaaatgggaaaagaaaaaggagaaactcgaaaagaaaggggagaaggagctgaggaaggaaattggaaaagagcttgaagagaagatcgtgggcaaaatacaaacccagattcagcagatcattgataaggacatcaacgccaaaatattgaagccctatcaagatgacgattctactgcaatcgacaaggaaaaactgattaaggacctcaaacaggagcagaagatcctgcagaaacttaagaatgagcaaacagcccgtgaaaaggagtaccaggaatgcattgcttatcaggaggaaagccggaaaatcaagcgatcagataaaagtagacagaagtacctgaggaaccaattgaaacgcaagtatccggaggtccctacccggaaggagatactctactatcaggaaaaaggcaaggtggcggtttggctggcaaatgacattaaaagattcatgcccacggattttaagaacgagtggaaaggggaacagcactccttactgcaaaagagcctagcctactacgagcagtgtaaggaagaactcaaaaatctgcttccacagcagaaggtgttcaaacatttgccttttgagctgggaggtcacttccaacagaagtatctctaccagttttataccaggtacctggacaaacgcttagaacatatctctggcctggtacagcaagctgagaacttcaagaatgaaaacaaagtctttaagaaggtggagaatgagtgcttcaaatttcttaagaaacagaactatacacacaaggggttggatgcccaggcacagtcagttctcggataccccatcttcctggaacgaggcttcatggacgagaaaccaactattatcaagggtaagacctttaaagggaatgaaagtctattcacagattggtttcggtattacaaggagtaccaaaacttccagactttttatgacaccgaaaactaccccctggtggagctcgagaaaaagcaggccgatcgtaaaagagaaacaaagatttatcaacagaagaaaaatgacgtcttcaccctgcttatggctaagcacatatttaaaagcgtgttcaagcaggattccatcgacaggttttctttggaggatctgtaccagtcgcgcgaggagcggttagaaaaccaagagaaagccaagcagactggcgagagaaatacgaactatatttggaataagacagtagacctcaacctgtgtgacggaaaagtgaccgttgaaaatgtcaaacttaagaacgtgggcaatttcatcaagtacgagtatgatcagagggtgcagacttttctgaaatacgaagagaacattaagtggcaagcattcttgatcaaagaaagcaaggaggaggaaaattacccttatatagtcgagcgagaaatcgagcagtacgagaaggttcgccgggaggaactcctgaaagaagtgcatctaattgaggaatatatcctggagaaggtgaaagacaaggagattctcaaaaagggggataaccagaatttcaagtactatatcctgaacggacttttgaaacagctgaagaatgaagacgtagagtcctacaaagtctttaacttaaacaccaagccagaagatgtgaatataaaccaactcaaacaggaggcgacagacctggaacagaaggctttcgttcttacctatattagaaataagtttgcccacaaccagctgccgaaaaaggagttctgggattactgccaagagaaatacggtaagatcgaaaaagagaagacttatgcagaatactttgccgaggtgttcaagagggaaaaagaggctctaatgaagtga

SEQ ID NO: 11294 - RNA, 3438 nt, synthetic construct
  misc_feature 1..3438: note = Cas13b variant__Chryseobacterium sp.__WP_047431796.1__Cas13b
  source 1..3438: mol_type = other RNA
atggagacccagacaatcggccacgggattgcctacgaccatagcaagatacaagataaacacttctttggaggtttcctgaacctcgctgaaaataacatcaaggcagtgcttaaagccttttccgagaagttcaatgtcggcaacgttgacgtgaaacagtttgcggatgtatctctgaaggacaatttgcccgataacgacttccagaagagagtgtcatttttaaaaatgtatttccctgtcgtggattttattaatatcccaaacaatagggctaagttccggagtgacctgactacgctatttaaaagcgttgatcagctccgcaacttctacacccattattaccacaagccgctggactttgatgcctcccttttcattctgttggacgatatcttcgcacgaacagccaaagaagtgcgtgaccaaaagatgaaggacgataaaactagacagctcctgtctaagtcgctgtcagaggaactccagaaagggtatgagttacagctggagaggcttaaggaattgaatcggctgggaaagaaggtcaacatacatgaccaactaggcatcaaaaatggtgtgctcaacaatgcttttaaccacctgatttacaaggatggggagagcttcaagaccaaacttacatatagttccgcactgacctcttttgaaagcgccgagaacggaatcgagatttcccagtcaggcctcttgttcctgttaagtatgtttctgaagcgcaaagaaatcgaggacctcaagaatagaaacaaaggcttcaaggctaaggtagttatagatgaagacgggaaagtgaatggacttaagtttatggccactcactgggtcttcagctacctgtgctttaaaggtttgaagtctaaactatccacagagttccatgaagagaccctgctcattcagatcattgatgagctgtcaaaggtgcccgacgaactttactgtgcgtttgataaggagacgagggacaaattcatcgaagatatcaacgagtatgtgaaggaaggccaccaggactttagcctggaggacgcaaaagtcattcatcctgttatacggaagcgctacgagaataaattcaactatttcgccatccgatttttggatgagttcgtgaagtttccaagtctcagattccaagtacacgtggggaattacgtccacgacaggcggattaagaacatcgatggaactacctttgaaacagaacgtgtggttaaagaccgcataaaggtgttcggcagactgtctgagatttccagctataaagctcagtacttatcgtctgtctccgataagcatgacgaaactggttgggagatctttcccaatccttcatatgtgttcatcaacaataacattccaatccacattagtgtagataccagctttaaaaaggagatagccgacttcaaaaagctgaggcgggcacaggttcccgatgaactaaagatccgaggggctgagaaaaagcgcaaatttgaaattacacaaatgatcggatccaagtctgtgctcaatcaggaggagcctatcgccctgcttagcttgaacgaaattccagcgctgctctacgagatactgatcaatggcaaagaaccggccgagattgaaagaatcattaaggacaaacttaacgagaggcaggatgtcatcaaaaactacaatcccgagaactggctgcctgcatcacagataagtcggcgcttgagatccaataagggcgaaaggatcattaacaccgacaaactcctgcaattagtgacgaaggagctgctagtcactgaacagaaactcaagatcattagcgataatcgtgaggctctgaagcagaaaaaggaagggaaatatatccggaagttcatatttacaaactctgagcttggacgagaggccatttggttggctgacgacatcaaaagattcatgccagccgatgtgaggaaggaatggaagggttaccagcattcacaactgcagcagagtctcgcattctataatagccgccccaaagaggccctggctattttagaatcctcttggaacctgaaggacgagaaaatcatatggaatgaatggatccttaagtcgtttacccagaacaaattctttgatgcgttctacaatgagtatttgaagggccggaaaaagtactttgcattcctcagcgagcacattgttcaatatacttccaacgccaagaatctgcagaaatttatcaagcagcagatgcctaaagacctattcgaaaagagacattacattatcgaggatctgcaaacagagaaaaacaagatactctcaaagccatttattttccccagggggatctttgacaaaaagccgaccttcatcaaaggagtgaaggtagaagatagtcctgagtctttcgctaattggtaccagtatggctaccagaaagaccaccaatttcagaagttctatgattggaagcgcgactacagcgatgtctttctggaacaccttggtaaacccttcattaacaacggggaccgacggacgttgggcatggaggaactgaaggagcgtatcattataaaacaggatttaaagatcaaaaagattaagatccaggacctctttctgagacttattgccgaaaatctgttccaaaaagtgtttaagtattccgcaaaattgccactctcagacttctacctgacccaggaggagaggatggaaaaggagaacatggccgctctacagaatgttcgcgaagagggagataaaagccctaacatcataaaggacaattttatctggtctaagatgattccctataaaaagggccagatcattgaaaacgccgtgaaactgaaggatatcgggaaactcaatgtcctgtcccttgacgataaggtgcaaacattgctgagttacgacgatgcaaaaccatggagcaagatagcgttagagaacgagttctctattggagaaaattcctacgaggtaatccggagagaaaagctctttaaagagatccagcagttcgaatcagagattctgtttaggagtggttgggacggcataaaccatcccgctcagcttgaggataatcgaaaccctaagttcaaaatgtatatcgtgaatgggattctgcgcaagagcgccggactatactcgcaaggcgaagacatctggttcgagtataacgcagattttaataacctcgacgccgacgttctggaaactaaatccgagttggtccagctggctttcttagtgaccgccattcggaacaagtttgcacacaatcagctcccagctaaggagttctacttttatatcagagccaaatacggtttcgcggatgaaccgtctgtggccctggtctatcttaactttacaaagtacgctataaatgagttcaaaaaggttatgatctga

SEQ ID NO: 11295 - RNA, 3453 nt, synthetic construct
  misc_feature 1..3453: note = Cas13b variant__Flavobacterium branchiophilum__WP_014084666.1__Cas13b
  source 1..3453: mol_type = other RNA
atggagaacctgaataagatcctcgacaaagaaaacgagatttgcataagcaagatcttcaataccaaaggcattgccgctcccatcacagaaaaggcacttgataacattaaatccaagcagaagaatgacctgaacaaagaggccagattgcactacttttctatcgggcattcattcaagcaaatagatactaaaaaggtgtttgactatgtcttaatcgaggaactgaaagatgagaagcctctaaagttcattacgctccagaaagactttttcaccaaggaatttagtatcaaactgcagaaacttattaatagcatcaggaacataaataaccactacgttcataatttcaacgatattaatctgaacaaaatcgactccaatgtgtttcacttcttgaaggagtcttttgaactcgcgattatcgagaaatattacaaggtaaacaagaaatatccactggataacgagatcgtgctgttcctcaaggaattatttattaaagacgagaatacagctctgcttaactacttcactaatttgtcgaaggatgaagccatagagtatatcctgaccttcacaattaccgaaaacaaaatctggaatataaacaatgagcataacattctaaatatcgagaagggaaagtacctcacttttgaagcaatgctgttccttatcacaatttttctgtacaaaaacgaggccaatcacttgctcccgaagctgtatgacttcaaaaacaataagtcaaaacaggaattatttaccttctttagcaagaagttcacgagtcaagatatcgacgctgaggaaggtcacctgattaaatttcgggacatgatacagtacctcaaccattatcccactgcatggaataacgatcttaagctggagtccgagaacaaaaataagatcatgaccacaaaattgattgactctatcatcgagttcgaactaaacagcaattacccttcctttgccactgatattcagttcaagaaggaagctaaagcctttctgttcgcgtcaaacaagaaacgcaatcagaccagtttcagcaacaagtcttataatgaggaaatacgacacaacccacatatcaaacaataccgtgacgagattgcatccgccctcacacccatctcatttaatgtcaaggaggataaattcaagatttttgtgaagaaacacgttctggaagagtatttccctaacagcatcggctacgaaaagtttcttgagtacaatgacttcaccgagaaagaaaaggaggattttgggctgaaattgtatagtaacccaaagacgaataagctcatagaaagaatcgacaaccacaaactggtgaagtctcatggaaggaatcaggatcggttcatggacttttccatgcgcttcttagctgagaacaactactttggcaaagatgccttctttaagtgttataaattctacgacactcaggaacaggacgagttcctgcaaagcaatgagaacaatgatgacgtcaagtttcacaagggtaaagtgacaacctatattaagtacgaggaacatctaaagaactattcgtactgggattgccccttcgtagaagagaataactctatgtccgttaagatctcaattgggagtgaagagaaaatcctcaagatacagagaaatctgatgatttactttcttgagaacgcattgtataatgaaaacgtggagaatcagggatacaagctggtcaacaattattacagggaactcaaaaaggacgtggaggaaagcatcgcttccctggatcttattaaatctaaccctgacttcaagagcaaatataagaaaatcctgccaaagcggttgctccacaattacgccccggcgaagcaagataaagcccccgagaacgcatttgagactctgttaaagaaagctgacttccgcgaggaacagtataagaaactgctaaagaaggccgaacatgagaaaaacaaggaggattttgtgaaacgaaataagggcaaacagttcaagctccactttataagaaaggcttgtcagatgatgtacttcaaagaaaagtacaacacactgaaagagggcaatgccgcatttgaaaagaaagaccctgtcatcgagaagaggaagaacaaagaacacgagttcgggcatcacaagaatcttaacattacccgggaggagttcaatgattattgcaaatggatgtttgccttcaacggaaatgactcatacaagaaatatttgcgtgatctgtttagtgaaaagcatttctttgacaaccaagaatacaagaatctcttcgagtccagcgttaacctggaggctttttatgcgaaaacgaaggaattattcaaaaagtggatcgagaccaataaaccaacaaacaatgaaaaccgctacactctggagaattataagaaccttattttgcagaaacaggtgtttatcaacgtataccacttctctaagtacctcatagacaagaatctgctaaactcagaaaataacgtgattcagtataaaagtctggagaatgtcgaatacctcatcagcgatttttatttccaatccaagctgtctatcgaccagtacaaaacctgtggtaaactttttaacaaattgaagtcgaataagctggaggattgcttactctatgagattgcatacaactatatcgacaaaaagaatgtgcacaaaattgatatacagaagatcctgacaagcaaaattatccttactattaacgacgccaataccccctacaagatctccgttcctttcaacaagctggaaagatacacagagatgatagctatcaaaaatcagaacaatttgaaggccaggttcctcattgatctgccactatatctgtcaaagaacaagatcaaaaagggcaaggacagtgcagggtacgaaattatcattaaaaacgatctcgagatagaggacatcaataccatcaacaataagattataaacgattctgtgaaatttactgaagtcctgatggagcttgaaaagtatttcatcttgaaagacaagtgtattctgagcaaaaattacatcgataactccgagattccctcattaaagcaatttagcaaggtgtggatcaaagaaaatgagaacgagataatcaattatcggaacattgcctgccatttccacctcccgctgcttgaaacgtttgacaatctgctactcaacgtagagcagaagttcatcaaagaggaactgcagaatgtttctacaattaacgacttgtccaagcctcaggaatacctgatcttactctttataaaattcaagcataataacttttatctgaaccttttcaataagaacgagagtaaaaccattaagaatgataaagaggtgaagaaaaaccgagtcctgcaaaagtttatcaatcaggtgatcttgaagaaaaagtga

SEQ ID NO: 11296 - RNA, 3642 nt, synthetic construct
  misc_feature 1..3642: note = Cas13b variant__Flavobacterium columnare__WP_060381855.1__Cas13b
  source 1..3642: mol_type = other RNA
atgagctccaagaacgagtcttacaataaacagaagaccttcaaccactataaacaagaagacaagtactttttcggcgggtttctgaataacgccgatgacaatctcagacaggtgggaaaagagttcaagacaaggatcaactttaatcataacaataacgaacttgcttcagtcttcaaggattattttaataaagagaagagtgttgcaaaacgggaacacgccctgaacttgttaagcaattacttccccgtgctggagcgcattcagaagcatactaaccacaattttgagcagacgcgagaaatattcgagctactcctggacaccatcaaaaagctgcgtgattattacacacatcactatcacaagcctattactatcaacccaaaagtatacgactttcttgatgacaccttgctcgatgtgctgattacaatcaagaaaaagaaagtcaagaacgacacctccagagaactgctcaaagagaagttcaggccggagttaactcaactgaagaatcagaaacgggaagaacttataaagaaaggtaagaaattgctggaagagaacctagaaaatgcggtgtttaaccattgcctccgccccttcctggaggagaataagacagatgacaagcagaacaaaaccgtttctcttagaaagtacaggaaatcgaagcctaatgaagagacgtcaatcactctgacccagagcggcttggtgttcctcatttcctttttcctgcaccggaaagaatttcaagtcttcacatccgggttagagggatttaaggctaaggtgaacactatcaaagaagaggagatttctctgaataagaacaatatcgtatatatgataacccattggagctactcctattacaacttcaaaggcctcaagcaccgcattaaaacagatcagggtgtttcaacccttgaacagaataacacgactcacagtctgacaaataccaacactaaggaggccttgctaacacagatcgtggactatctgagcaaggtcccaaacgaaatttacgagaccctctctgaaaaacaacagaaggagtttgaggaagacatcaatgagtatatgcgagaaaaccccgagaatgaggattccacgttctcaagcatcgtgagtcataaagtgattagaaagaggtacgaaaacaaatttaattacttcgcaatgcggtttctggacgagtatgccgaacttcctaccctgcgtttcatggtcaactttggggattacataaaggaccgccagaaaaagatcttggagtctattcaattcgattccgaaagaatcataaagaaagagattcacctcttcgagaagctgggattagttacagaatataaaaagaatgtgtacctgaaagagactagcaacatcgacctatcgaggtttccactcttcccctctccttcctatgtaatggctaataacaatatcccattttacattgattcacggagtaacaatctggacgaatatcttaaccagaagaagaaagcacagagccagaatcgaaagcgcaacttgaccttcgagaaatacaacaaggaacaatccaaagatgccatcattgctatgctgcagaaggagataggcgtgaaggacctccagcagagatctacaatcggcctgcttagctgtaatgagctgccgtcaatgttgtacgaagtcattgtgaaagatatcaagggggccgagctcgaaaacaaaatcgcgcaaaagattagggagcagtatcagagtatacgggactttactctggacagtccccagaaagataatatccctaccacattaaccaagactattagcacggacacatctgttaccttcgaaaaccaaccaatcgatattccccgcctgaagaatgcactacagaaagagctcactctgacccaggagaaacttttgaacgtgaaacagcatgaaatcgaggtcgacaattacaacagaaataagaacacatataaatttaagaatcaacctaaagataaggtggacgataacaagctgcagaggaaatacgtattctatcgtaatgaaataggacaggaggccaactggctcgcttcagacctgatccactttatgaagaataaaagtttatggaagggttacatgcataacgagctgcagagcttccttgcctttttcgaagataaaaagaacgactgcattgcattgctcgagaccgtttttaatctgaaggaagattgtatcctaactaaagacctgaagaacctcttcctgaaacacggcaatttcattgatttttataaggagtaccttaaattgaaggaagacttcctgaacacagagtccacgtttttagagaatgggttcatcggactcccacccaagatactgaaaaaggaactttctaaacggctgaactacatttttatcgtgttccaaaagcgacagtttattatcaaagagttggaagagaagaagaataacctctatgctgacgccataaatctgtcgagaggcatcttcgatgaaaaaccgaccatgattccttttaagaaacccaacccagacgagttcgcgagctggtttgtcgcctcctaccagtataataactaccaatcattctatgagctaactcctgataagatcgaaaatgacaaaaagaagaaatacaagaacctgagggcaattaataaagtgaagatccaggattattacctcaaactgatggtcgacacactttaccaggatttgttcaaccagcccctggacaagagtttatctgatttttatgtgagcaaaaccgaccgcgagaagataaaggctgatgccaaggcttaccaaaagcggaatgactccttcctctggaacaaagttattcacctgtcacttcagaacaatagaatcacagccaacccaaagctgaaagatatcggtaagtataagagggcactacaggacgagaaaattgccactctcctgacctacgacgatcgcacgtggacctatgctttgcagaagcccgagaaagaaaatgagaacgactacaaggagctgcattatacagcgttaaatatggaactccaagagtacgaaaaagtgcgaagcaagaagctgcttaaacaggtacaggagctggagaagcaaatcttggataaattttacgacttctctaacaatgcaactcaccctgaagatctcgagattgaagacaagaaagggaagcggcatccaaactttaagctgtatataaccaaagccctactgaagaatgagtccgaaatcattaaccttgagaatatcgatattgagatcctcataaaatactatgactacaacacagaaaagctgaaagagaagatcaaaaatatggatgaagacgagaaggctaagattgtcaacactaaagaaaattataacaagatcaccaacgtgttgattaaaaaggccctggttttaatcataattcgtaataaaatggcacacaaccagtacccgcccaagttcatctatgatctcgccacgagatttgtgcctaagaaagaggaggaatacttcgcttgctactttaatagggtcttcgagacaatcaccactgaactgtgggagaacaagaaaaaggccaaagaaattgtgtga

SEQ ID NO: 11297 - RNA, 3540 nt, synthetic construct
  misc_feature 1..3540: note = Cas13b variant__Flavobacterium columnare__WP_014165541.1__Cas13b
  source 1..3540: mol_type = other RNA
atgagctccaagaacgagtcttacaataaacagaagaccttcaaccactataaacaagaagacaagtactttttcggcgggtttctgaataacgccgatgacaatctcagacaggtgggaaaagagttcaagacaaggatcaactttaatcataacaataacgaacttgcttcagtcttcaaggattattttaataaagagaagagtgttgcaaaacgggaacacgccctgaacttgttaagcaattacttccccgtgctggagcgcattcagaagcatactaaccacaattttgagcagacgcgagaaatattcgagctactcctggacaccatcaaaaagctacgtgattattacacacatcactatcacaagcctattactatcaacccaaaaatttacgactttctggatgacaccttgctcgatgtactgatcacaataaagaaaaagaaagtgaagaacgacacctccagagaactgctcaaagagaagttaaggccggagctgactcaacttaagaatcagaaacgggaagagttgatcaagaaaggtaagaaactgctagaagagaacctcgaaaatgcggtcttcaaccattgcctgcgcccctttcttgaggagaataagacagatgacaagcagaacaaaaccgtgtctctgagaaagtacaggaaatcgaagcctaatgaagagacgtcaattactttgacccagagcggcctcgttttcctgatgagtttctttttacaccggaaagagttccaagtgtttacatccgggctggaaggattcaaggctaaggtcaacactatcaaagaagaggagatttctctcaataagaacaatatcgtgtatatgataacccattggagctactcctattacaactttaaaggccttaagcaccgcattaaaacagatcagggtgtatcaaccctggaacagaataacacgactcacagtttgacaaataccaacactaaggaggccctactgacacagatcgttgactatctcagcaaggtgccaaacgaaatttacgagaccctgtctgaaaaacaacagaaggagttcgaggaagacatcaatgagtatatgcgagaaaaccccgagaatgaggattccacgttttcaagcatcgtcagtcataaagtgattagaaagaggtacgaaaacaaattcaattactttgcaatgcggttccttgacgagtatgccgaactgcctaccttgcgttttatggtgaacttcggggattacataaaggaccgccagaaaaagatcctcgagtctattcaatttgattccgaaagaatcataaagaaagagattcacctgttcgagaagttaagcctggtcacagaatataaaaagaatgtttacctaaaagagacttcgaacatcgacctctctaggttcccactgtttcccaatccttcctatgtgatggctaacaataacatcccattctacattgattcacggagtaataaccttgacgaatatttgaatcagaagaagaaagcacagagccagaacaagaaacgaaacctgacctttgagaagtacaataaagaacaatccaaggatgccatcattgctatgctccagaaggagataggagtaaaagacctgcagcagcgctctacaatcggccttctgagctgtaacgagttgccgtcaatgctctacgaagtgattgtcaaggatatcaaaggcgccgagctggaaaataagatcgcgcaaaagattagagagcagtatcagagtataagggacttcactttagacagcccccagaaggataacatccctaccacactgattaagaccatcaatactgactcctctgtgacgtttgaaaaccaaccaattgatatcccccggcttaaaaatgcaatacagaaggagctcacactgacccaggagaaacttttgaacgttaaggaacatgagatcgaagtggacaattacaaccgcaataaaaacacttataagttcaaaaatcagcctaagaacaaggtcgatgacaaaaagctgcaaagaaaatacgtgttttataggaatgagattcgtcaggaggccaactggctcgcttcagatctgatccacttcatgaagaacaaaagtttatggaaggggtacatgcataatgaactgcagagctttcttgccttctttgaggacaagaaaaacgattgcattgcattgctcgaaaccgtattcaatctgaaggaggactgtatcctaacaaaaggactgaagaacctctttctgaaacacggtaatttcatagatttctataaggaataccttaagttgaaagaggactttctgaacaccgagtccactttcttagaaaatggcctcattgggctgccacccaagatccttaaaaaggagctgtctaaacggtttaagtacattttcatcgtttttcaaaagcgacagttcataatcaaagaattggaggaaaagaaaaacaatctctatgctgatgccattaacctgtcgagaggaatctttgacgagaagccgacaatgattcctttcaaaaagcccaatccagacgagtttgcgagctggttcgtggcctcctaccagtataacaattaccagtcattttatgaactaacgcctgatatcgtcgagagggacaagaaaaagaaatacaagaacctgcgcgcaataaataaagtgaagattcaagattattacctcaaactgatggtcgacaccctttaccaggatttgttcaaccagcccctggacaagagtttatctgatttctatgtgagcaaggctgaacgggagaaaatcaaggccgacgctaaagcctaccagaagagaaatgattcctcactctggaacaaagttatccacctgagccttcaaaacaataggattactgcaaacccaaagctgaaggacatcggcaaatataagcgcgccctacaggatgagaaaattgctacactcctgacctacgacgatcgaacatggacttatgcgttgcagaagcccgaaaaagagaatgaaaacgactacaaggagctgcattataccgcattaaatatggaactccaggagtacgagaaggtgcggtctaaagaactgcttaagcaagtacaggagctggaaaaacagatattggaggaatacacggactttctctccacccaaatccaccctgccgatttcgagcgtgagggtaacccaaattttaagaaatatctggctcatagtattctagaaaacgaggacgatctggacaaacttccggaaaaggtcgaggccatgagagaactcgatgagacaatcactaatcccattatcaaaaaggcaatagtgctgatcattatcaggaacaaaatggcccacaatcagtaccctccaaagttcatttatgacttggctaaccgctttgttcccaaaaaggaggaagagtacttcgccacctattttaatcgggtgttcgaaacaatcactaaagagctgtgggaaaacaaggagaagaaagataagacccaggtctga

SEQ ID NO: 11298 - RNA, 3642 nt, synthetic construct
  misc_feature 1..3642: note = Cas13b variant__Flavobacterium columnare__WP_063744070.1__Cas13b
  source 1..3642: mol_type = other RNA
atgagctccaagaacgagtcttacaataaacagaagaccttcaaccactataaacaagaagacaagtactttttcggcgggtttctgaataacgccgatgacaatctcagacaggtgggaaaagagttcaagacaaggatcaactttaatcataacaataacgaacttgcttcagtcttcaaggattattttaataaagagaagagtgttgcaaaacgggaacacgccctgaacttgttaagcaattacttccccgtgctggagcgcattcagaagcatactaaccacaattttgagcagacgcgagaaatattcgagctactcctggacaccatcaaaaagctacgtgattattacacacatcactatcacaagcctattactatcaacccaaaaatttacgactttctggatgacaccttgctcgatgtactgatcacaataaagaaaaagaaagtgaagaacgacacctccagagaactgctcaaagagaagttaaggccggagctgactcaacttaagaatcagaaacgggaagagttgatcaagaaaggtaagaaactgctagaagagaacctcgaaaatgcggtcttcaaccattgcctgcgcccctttcttgaggagaataagacagatgacaagcagaacaaaaccgtgtctctgagaaagtacaggaaatcgaagcctaatgaagagacgtcaattactttgacccagagcggcctcgttttcctgatgagtttctttttacaccggaaagagttccaagtgtttacatccgggctggaaggattcaaggctaaggtcaacactatcaaagaagagaagatttctctcaataaaaacaatatcgtgtatatgataacccattggagctactcctattacaactttaagggccttaaacaccgcattaagacagatcagggtgtatcaaccctggagcagaataacacgactcacagtttgacaaataccaacactaaggaagccctactgacacagatcgttgactatctcagcaaagtgccaaacgagatttacgaaaccctgtctgagaagcaacagaaagagttcgaagaggacatcaatgaatatatgcgagagaaccccgaaaatgaggattccacgttttcaagcatcgtcagtcataaggtgattagaaaaaggtacgagaacaagttcaattactttgcaatgcggttccttgacgaatatgccgagctgcctaccttgcgttttatggtgaacttcggggattacataaaagaccgccagaagaagatcctcgaatctattcaatttgattccgagagaatcataaagaaggaaattcacctgttcgagaaattaggactggtcacagagtataagaaaaatgtttacctaaaggaaactagcaacatcgacctctcgaggttcccactgtttccctctccttcctatgtgatggctaataacaatatcccattctacattgattcacggagtaacaatcttgacgagtatttgaaccagaagaaaaaggcacagagccagaatcgaaaacgcaacctgacctttgaaaagtacaacaaagagcaatccaaggatgccatcattgctatgctccagaaggaaataggcgtaaaagacctgcagcagagatctacaatcggccttctgagctgtaatgagttgccgtcaatgctctacgaggtgattgtcaaggatatcaaaggggccgaactggagaacaagatcgcgcagaaaattagggaacaatatcagagtatacgggacttcactttaaatagcccccagaaggacaacatccctaccacactgattaagaccatcagcactgatacgtctgtgacatttgagaatcaaccaattgacatcccccgccttaaaaacgcaatacagaaggaactcgccctgacccaggagaaacttttgaatgttaagcagcatgagatcgaagtgaacaattacaacagaaataaaaacacttataagttcaaaaatcaacctaaggataaggtcgacgataacaaactgcagaggaagtacgtgttttatcgtaatgagattggacaggaagctaactggctcgcctcagacctgatccacttcatgaaaaacaagagtttatggaaaggttacatgcataatgagctgcaatcctttcttgcattctttgaggataagaagaacgactgcattgctttgctcgaaaccgtattcaatctgaaagaggattgtatcctaacaaaggacctgaaaaacctctttctgaagcacggcaatttcatagatttctataaagaataccttaagttgaaggaggactttctgaacaccgaatccactttcttagagaatgggtttattggactcccacccaaaatcctgaagaaagagctttctaagcggctgaactacattttcatcgtttttcagaaacgacagttcataatcaaggaattggaggaaaagaaaaataacctctatgccgatgcgattaatctgtcgagaggcatctttgacgagaagccgacaatgattcctttcaaaaagcccaacccagacgaatttgccagctggttcgtggcatcctaccagtataataactaccaatcattttatgagctaacgcctgataaaatcgagaatgacaagaagaaaaagtacaaaaacctgagggctataaataaggtcaaaattcaggattattacctcaagctgatggtggacaccctttaccaggatttgttcaaccagcccctggacaaaagtttatctgatttctatgtcagcaagactgaccgcgaaaagatcaaagccgatgctaaggcctaccaaaaacggaacgactcctttctctggaataaggtgatccacctgtcacttcagaacaatagaattacagcaaacccaaaactgaaggatatcggtaagtataaaagggccctacaggacgagaagattgctaccctcctgacatacgatgaccgcacttggacctatgcgttgcagaaacccgaaaaggagaatgaaaacgactacaaagagctgcattatacggcattaaatatggagctccaagaatacgagaaggttcgaagcaagaaactgcttaaacaggtgcaggaactggagaaacaaatattggataagttctacgacttttctaacaatgccacccaccctgaggatctcgaaatcgaggacaaaaaggggaagcggcatccaaacttcaaactgtatattacaaaggctctactgaaaaatgaatccgagatcattaaccttgaaaatatcgatatagagatcctcattaagtactatgactacaacactgagaaactgaaggagaaaatcaagaatatggatgaagacgaaaaggccaaaattgtaaacaccaaggagaactataataaaatcacaaacgtcttgataaagaaagcactggtgttaattatcatccgtaataagatggcccacaaccagtacccgcccaagtttatttatgatctcgctactagattcgttcctaaaaaggaagaggagtactttgcctgctacttcaatagggtgtttgaaaccataacgacagagctgtgggaaaacaaaaagaaagcaaaggagatcgtctga

SEQ ID NO: 11299 - RNA, 3645 nt, synthetic construct
  misc_feature 1..3645: note = Cas13b variant__Flavobacterium columnare__WP_065213424.1__Cas13b
  source 1..3645: mol_type = other RNA
atgagctccaagaacgagtcttacaataaacagaagaccttcaaccactataaacaagaagacaagtactttttcggcgggtttctgaataacgccgatgacaatctcagacaggtgggaaaagagttcaagacaaggatcaactttaatcataacaataacgaacttgcttcagtcttcaaggattattttaataaagagaagagtgttgcaaaacgggaacacgccctgaacttgttaagcaattacttccccgtgctggagcgcattcagaagcatactaaccacaattttgagcagacgcgagaaatattcgagctactcctggacaccatcaaaaagctacgtgattattacacacatcactatcacaagcctattactatcaacccaaaaatttacgactttctggatgacaccttgctcgatgtactgatcacaataaagaaaaagaaagtgaagaacgacacctccagagaactgctcaaagagaagttaaggccggagctgactcaacttaagaatcagaaacgggaagagttgatcaagaaaggtaagaaactgctagaagagaacctcgaaaatgcggtcttcaaccattgcctgattccctttcttgaggagaataagacagatgacaagcagaacaaaaccgtgtctctgcgcaagtacagaaaatcgaagcctaatgaagagacgtcaatcactttgacccagagcggcctcgttttcctgatgagtttctttttacacaggaaagagttccaagtgtttacatccgggctggaacggttcaaggctaaggtcaacactattaaagaagaggagatctctctcaataagaacaatatagtgtatatgattacccattggagctactcctattacaactttaaaggacttaagcaccgcatcaaaacagatcagggcgtatcaaccctggaacagaataacacgactcacagtttgacaaataccaacactaaggaggccctactgacacagattgttgactatctcagcaaggtgccaaacgaaatctacgagaccctgtctgaaaaacaacagaaggagttcgaggaagacatcaatgagtatatgcgagaaaaccccgagaatgaggattccacgttttcaagcattgtcagtcataaagtgataagaaagaggtacgaaaacaaattcaattactttgcaatgcggttccttgacgagtatgccgaactgcctaccttgcgttttatggtgaacttcggtgattacatcaaggaccgccagaaaaagattctcgagtctatccaatttgattccgaaagaataattaagaaagagatccacctgttcgagaagttaagcctggtcacagaatataaaaagaatgtttacctaaaagagacttcgaacatcgacctctctaggttcccactgtttcccaatccttcctatgtgatggctaacaataacattccattctacatcgattcacggagtaataaccttgacgaatatttgaatcagaagaagaaagcacagagccagaacaagaaacgaaacctgacctttgagaagtacaataaagaacaatccaaggatgccattatagctatgctccagaaggagatcggggtaaaagacctgcagcagcgctctacaattggacttctgagctgtaacgagttgccgtcaatgctctacgaagtgatcgtcaaggatatcaaaggcgccgagctggaaaataagattgcgcagaaaataagagagcaatatcagagtatcagggacttcactttagacagcccccagaaggataacattcctaccacactgatcaagaccattaatactgactcctctgtgacgtttgaaaaccaaccaatcgatataccccggcttaaaaatgcactccagaaggagctgacacttacccaggagaaattgctgaacgttaaggaacatgagatcgaagtggacaattacaaccgcaataaaaacacttataagttcaaaaatcagcctaagaacaaggtcgatgacaaaaagctccaaagaaaatacgtgttttataggaatgagattcgtcaggaggccaactggctggcttcagatttaatccacttcatgaagaacaaaagtctgtggaagggctacatgcataatgaacttcagagctttttggccttctttgaggacaagaaaaacgattgcattgcactcctggaaaccgtattcaatctaaaggaggactgtatcctgacaaaagggctcaagaacctgtttcttaaacacggaaatttcatagatttctataaggaatacttgaagctgaaagaggactttttatccaccgagtctactttcctcgaaaacggttttattggcctgccacccaagatccttaaaaaggagctgtcgaaacggttgaagtacattttcatcgtttttcaaaagcgacagttcataatcaaagaactcgaggaaaagaaaaataacctgtatgctgatgccattaatctaagcagagggatctttgacgagaagccgacaatgattcctttcaaaaagcccaacccagacgagtttgcgtcctggttcgtggcctcataccagtataataactaccagagtttttatgaactgacgcctgatatcgtcgagagggacaagaaaaagaaatacaagaatctccgcgcaataaacaaagtgaagattcaagattattacctgaaacttatggtcgacaccttgtaccaggatctgttcaatcagcccttagacaagtctctcagcgatttctatgtgtccaaggctgaacgggagaaaatcaaggccgacgctaaagcctaccagaagctgaacgattcaagcctttggaataaagttatccacctgtctctacaaaacaacagaattactgcaaatccaaagctcaaggacatcggaaaatataagagggccctgcaggatgagaaaattgctacattgctgacctacgacgcgcgcacatggacttatgcattacagaagcccgaaaaagagaacgaaaatgattacaaggagctccattataccgccctgaacatggaacttcaggagtacgagaaggtgcgatccaaagaactgttgaagcaagtacaggagctcgagaaaaagatactggacaaattttacgacttcagtaataacgctagccaccctgaagatctagaaatcgaggacaagaagggcaaacggcatccaaattttaagctgtatattacgaaagcccttctcaagaacgagtctgaaatcattaatctggagaacatcgatatagaaatcttgctgaaatactatgactacaataccgaggaattaaaggagaaaattaagaacatggatgaggacgaaaaggcaaaaatcattaatacaaaggagaactataataaaatcactaacgtcctcataaagaaagccctggtgcttattatcatccgtaacaagatggctcacaatcagtacccgcccaagttcatttatgatctggccaacagatttgttcctaaaaaggaagaggaatacttcgcaacctactttaatagggtgttcgagacaataactaaagagttgtgggaaaacaaggagaaaaaggacaagacccaagtctga

SEQ ID NO: 11300 - RNA, 3468 nt, synthetic construct
  misc_feature 1..3468: note = Cas13b variant__Flavobacterium sp.__WP_045968377.1__Cas13b
  source 1..3468: mol_type = other RNA
atggacaacaatatcaccgtggagaagacagaactgggcctcgggattacttacaaccacgataaagtcgaggacaagcattatttcggaggtttcttcaatcttgcccagaacaatatagatctggttgctcaagaatttaaaaagagattgttaatccagggcaaagacagcattaacatcttcgcaaattacttttccgatcagtgctctattacgaacctggagagggggatcaagatactagccgaatatttccccgtggtatcatacatcgacctcgatgagaagaataaaagtaagagcattcgggagcacctgatccttctgttggaaaccattaacaatctccgcaactattacacacattattaccacaaaaagatcataattgacggatccctgtttcctctgctcgatactatcttactgaaagtggtccttgagattaagaagaaaaagttgaaagaagacaagaccaaacagctgctaaagaaaggcctcgagaaggagatgacaatcctgttcaatcttatgaaggcggaacaaaaagagaagaaaatcaagggttggaacattgatgaaaatataaaaggggctgtgctgaaccgagccttttctcatttgctctacaacgacgagctgtcggattatcgtaagtcaaagtacaataccgaagacgagactttaaaagacacactgaccgagagcggaatcctcttccttctgagctttttcttgaacaagaaagaacaggagcagctaaaggcaaatattaaaggctataagggcaagatcgcctccataccagatgaagagattacgctgaaaaacaattctctcagaaacatggctactcactggacctacagccacctgacatataaggggcttaaacataggatcaagactgaccacgaaaaagagaccctgttggttaatatggtggattacctctccaaggtcccgcatgagatctatcagaacctgtcagaacaaaataagagtttatttctggaggacattaacgaatacatgcgggataatgaggaaaaccacgacagctctgaggcatcccgcgtgatccaccccgtaattagaaaaaggtacgagaataagttcgcctatttcgctatacggtttctagatgaatttgccgagtttcctacactccgcttcatggttaacgtgggaaattacatccatgacaaccgaaagaaggatattggtggcacctcactgatcacgaacagaactatcaaacagcagattaatgtctttgggaaccttacagaaatacacaagaaaaagaatgactatttcgagaaggaggaaaacaaagagaagaccttggaatgggagctgtttccaaatcccagctaccatttccagaaagaaaacatccctatttttatcgatctcgagaagagtaaagagactaatgacctggcgaaggaatatgcaaaggagaaaaagaaaattttcggatcttccaggaagaaacaacagaacacagccaagaagaatcgggaaaccatcataaaccttgtgtttgacaaatacaagacgagcgatcgtaaaaccgtgacattcgagcagccaactgctctgttgtcgtttaatgaactcaactctttcctgtatgccttcttagtcgagaataagaccggcaaagagctggaaaagatcattatcgagaagattgcaaaccaataccagatcctcaaaaattgttcctcaacagttgacaagactaacgataacatacccaaaagtattaagaaaatcgtgaataccacaaccgacagcttttacttcgaaggtaagaaaattgatatcgagaagctagaaaaggacataactatcgagattgagaaaacgaacgaaaagctggagacaatcaaagaaaatgaggagtccgctcagaactataagcgcaatgaaagaaacacccagaaaaggaaactttaccggaagtatgtatttttcactaatgagattgggatcgaagccacctggataacaaacgatattttgcgatttctggacaataaagagaactggaagggataccaacactctgaactccagaaattcatcagccagtatgataattacaagaaagaggcgctgggcttactggagtcagaatggaaccttgagagtgacgcctttttcggccagaatttgaagcgcatgtttcaatccaacagcaccttcgaaactttttataagaaatacctcgataatagaaagaacacactggagacgtacctatctgcaatcgaaaacctgaaaaccatgactgacgtgaggcctaaggtcctcaaaaagaagtggacagagctgttccggtttttcgataaaaagatttatcttttgtcaaccatcgagacaaaaattaatgaactgataactaagccaatcaacttaagtcgcgggattttcgaggaaaaaccgacctttatcaatggaaagaaccccaataaggagaacaatcagcatctcttcgctaactggtttatttacgccaaaaagcagacgatcctgcaggacttctataatcttcctctggaacaaccaaaagctataaccaacttgaagaaacacaagtacaaactcgagagaagcatcaataacctgaagattgaggacatctatattaagcagatggtggattttctataccagaaactgttcgaacagtcctttatcggttctctccaagacctgtatacatcgaaggagaaaagggaaatagagaagggcaaagccaagaatgagcagactcccgatgaaagtttcatttggaagaaacaggttgagatcaacacccacaatgggcgtatcattgcaaagacaaaaataaaggacatcggaaaatttaagaaccttttgactgataataagattgcccatctgatctcctacgacgatcggatttgggacttctcattaaacaacgatggcgacatcaccaaaaagctctacagtataaatacggaactggagtcttatgaaacaatccgaagagagaaacttctgaagcaaattcagcagtttgagcagttcctactcgaacaagagaccgaatacagcgctgagaggaaacaccctgaaaagttcgagaaggattgcaacccaaattttaaaaagtatatcattgagggtgtgctgaacaaaatcatacccaatcatgaaattgaggaaatcgagatcttgaagtccaaagaagacgtcttcaagattaacttttcagatatcctgatattaaataacgacaatattaaaaaggggtacctcctgatcatgattcgcaacaagttcgcgcacaatcagcttatcgacaaaaacctgtttaatttcagcttgcagctctattctaagaacgagaatgagaacttttccgaatacctgaacaaagtgtgtcagaatataattcaagagttcaaggaaaaactaaagtga

SEQ ID NO: 11301 - RNA, 3480 nt, synthetic construct
  misc_feature 1..3480: note = Cas13b variant__Myroides odoratimimus__EHO06562.1__Cas13b
  source 1..3480: mol_type = other RNA
atgaaggacatcctgaccacagatactacggagaaacagaacagattctacagccacaagattgccgacaaatatttcttcggcgggtactttaatctcgcttccaacaatatatatgaagtgttcgaggaagtcaacaagaggaatacctttggaaaacttgcaaagcgggataacggtaatctgaagaactacatcattcatgttttcaaagacgagttgtctatctcagattttgaaaagcgcgtggccattttcgcgagttattttcccatcttagagacagtagacaaaaagagcataaaagagcgaaatcgtactatcgatctgaccctatcccaaagaattaggcagttccgggaaatgctcatctctctggtgacagctgtcgaccagcttcgcaacttttacacccactatcatcactcggatattgtgatcgagaataaggttctggacttcttgaacagctcatttgtgagtactgccctccatgtcaaggataaatacctgaagacagacaaaaccaaggaatttctgaaagagacgatagcagccgagctcgatattttaatcgaggcttacaagaaaaagcagattgaaaagaaaaatactagattcaaggcaaacaaaagggaagacatcctgaatgccatctataacgaggctttttggtccttcattaacgacaaggataaagacaaggataaggaaaccgtggtagccaaaggcgcggacgcatactttgagaagaatcaccacaaatctaacgatcctgacttcgcccttaatataagcgagaaggggatcgtttatttgctgtcctttttcctaacaaacaaagaaatggattcactcaaggctaatctgactggatttaagggcaaagtggaccgggagagtggtaacagcattaagtacatggccacccaacgcatctattctttccatacataccgagggcttaaacagaagataagaacctccgaagagggagtcaaagaaacgctgttgatgcagatgattgatgagctctcaaaggtgccaaatgtggtctatcagcacctgagcactacacaacagaacagttttatcgaggactggaatgaatactacaaggattatgaggacgacgttgaaaccgatgacttatctagggtgatccatccggtaattcggaaacgttacgaggatcgcttcaactattttgcaatcagattcctggacgaatttttcgatttccccactctcaggtttcaggtgcaccttggcgactacgtccacgatcggcgaacaaagcagctgggcaaagtggagtccgaccgcattataaaggagaaagttaccgtgttcgctagattgaaggatatcaatagcgccaaagcgtcgtattttcattctctagaggaacaagacaaggaggaactggataacaagtggaccctcttccctaatccatcctacgactttcccaaagagcacacgctgcagcatcagggggaacaaaagaacgccggaaaaattggtatctatgtcaaacttagggatacacagtacaaagagaaggcagctctggaagaggcccggaagtcattgaatcctaaagaacgcagtgctactaaggccagcaaatacgacatcattacccagataatcgaggcaaacgacaacgtgaagtccgagaaaccactcgtattcacaggccagcccattgcctatctgtctatgaatgatatccacagcatgttattttcactgctaactgacaacgctgaactcaagaagacccctgaggaagttgaggcgaaactgattgatcaaatcgggaagcagataaatgaaatccttagtaaagacacagataccaagattttgaaaaagtacaaggacaacgatctgaaagagactgacacggataagatcacaagagacctcgcaagggataaagaggaaattgagaagctgatccttgaacagaaacagcgtgccgacgattataattacacctccagcactaagttcaacatagacaaatctcggaagcgaaagcatctgttgtttaatgctgagaaaggaaagattggcgtgtggctcgccaacgacatcaaaagattcatgtttaaggaatcaaaaagtaagtggaagggttatcaacacaccgagctgcagaaattattcgcatactttgatacaagcaagtccgacctggagctaattctctctaatatggtcatggtgaaagattatccaatcgaactgatagaccttgtcaagaaatcgaggaccttggtggatttcctgaacaagtacctcgaggcccgcctggaatacatcgagaatgttattactcgggtgaagaacagcatcgggacaccgcagttcaaaacggtaagaaaggagtgctttaccttcttaaagaagtccaattatactgtcgtgtcactggacaaacaggttgaaaggattcttagtatgcccttgtttatcgagcgcggattcatggatgacaagcctacaatgctcgaaggcaagtcttacaaacaacacaaggagaaatttgctgattggttcgtgcattataaggaaaacagcaattaccagaacttttatgacaccgaggtctacgagataacaactgaagataaacgagagaaggccaaggtgaccaaaaagattaaacagcagcaaaagaacgacgtattcacgctgatgatggtgaattatatgctagaagaggttctgaaactctcctcaaacgaccggctgagccttaatgaattgtaccagaccaaggaggagcgtatcgtcaacaaacaggtggcaaaggatacacaagaaagaaataagaactacatctggaataaagtggtcgacctgcagttatgtgatggcctcgttcacattgacaacgtgaagctgaaagatatcgggaattttaggaagtatgagaacgactctcgcgtgaaagagttccttacttaccagtccgatattgtatggagtgcgtatctgagcaatgaagtcgactctaacaagttgtacgtgatagaacggcagctcgataattatgagtccatcagatcaaaggagctgctaaaagaagttcaagagattgaatgcagtgtgtacaaccaggtcgctaataaggagagcctgaaacagtcgggaaacgagaactttaagcagtatgtgctccaaggtctgcttccaatcggcatggacgttagggaaatgttgattctgtccaccgatgtgaaattcaagaaggaggaaatcatacagttagggcaggccggagaggtagaacaggacctctactctctgatctacattcgaaataaattcgcacataaccaacttcccatcaaggagtttttcgatttttgtgagaataactatcgcagcatttcagacaatgaatactatgccgagtactatatggaaatcttccggagtataaaagagaagtacgctaactga

SEQ ID NO: 11302 - RNA, 3474 nt, synthetic construct
  misc_feature 1..3474: note = Cas13b variant__Myroides odoratimimus__WP_006261414.1__Cas13b
  source 1..3474: mol_type = other RNA
atgaaggacatcctgaccacagatactacggagaaacagaacagattctacagccacaagattgccgacaaatactttttcggcgggtattttaatctcgcttccaacaatatatatgaagtgttcgaggaagtcaacaagaggaatacctttggaaaacttgcaaagcgggataacggtaatctgaagaactacatcattcatgttttcaaagacgagttgtctatctcagattttgaaaagcgcgtggccattttcgcgagttattttcccatcttagagacagtagacaaaaagagcataaaagagcgaaatcgtactatcgatctgaccctatcccaaagaattaggcagttccgggaaatgctcatctctctggtgacagctgtcgaccagcttcgcaacttttacacccactatcatcactcggagattgtgatcgaaaataaggttctggatttcttgaactcaagcctcgtgagtactgccctgcatgtcaaggacaaatacctgaagacagataaaaccaaggagtttctcaaagagacgatagcagccgaattagacattctgatcgaggcttacaagaaaaagcagattgaaaagaaaaatactagattcaaggcaaacaaaagggaggatatccttaatgccatctataacgaggctttctggtcctttattaacgacaaggacaaagataaggaaaccgtggtagccaagggcgcggacgcatacttcgagaaaaatcaccacaagtctaacgatcctgactttgccttgaatataagcgaaaaagggatcgtttatctgctatccttctttctcacaaacaaggagatggattcactgaaagctaatcttactggattcaagggcaaggtggaccgggaaagtggtaacagcattaaatacatggccacccaacgcatctattcttttcatacataccgagggctgaagcagaaaataagaacctccgaggaaggagtcaaggagacgttgctcatgcagatgattgatgagctgtcaaaagtgccaaatgtggtctatcagcacttaagcactacacaacagaacagtttcatcgaagactggaatgagtactacaaggattatgaagacgatgttgagaccgacgacctgtctagggtgatccatccggtaattcggaagcgttacgaagatcgctttaactatttcgcaatcagatttctcgacgagttctttgatttccccactcttaggttccaggtgcacctgggcgactacgtccacgatcggcgaacaaaacagttgggcaaggtggagtccgaccgcattataaaagaaaaggttaccgtgtttgctagactaaaagatatcaatagcgccaaggcgaactatttccattcgctggaggaacaagacaaagaggagctcgataataagtggacgctgtttcctaacccatcttacgacttccccaaggaacacacccttcagcatcagggggagcaaaagaatgccggaaagattggtatctatgtcaaactgagggatacacagtacaaggaaaaagcagctttggaggaagcccggaagtccctcaaccctaaggagcgctcagctactaaagccagtaagtacgacatcattacccagataatcgaggcaaacgataatgtgaaaagcgaaaagccactggtatttacaggccagcccattgcctatttatccatgaacgacatccactctatgctgttcagcctactcactgacaatgctgagctgaaaaagacccctgaagaggttgaagcgaagttgattgatcaaatcgggaaacagataaacgagatcttgtcaaaggacacagataccaaaattctgaagaaatacaaggacaatgatctcaaggagactgacacggataaaatcacaagagacctggcaagggataaggaagagattgaaaaacttatcctggagcagaagcagcgtgccgacgattataactacaccagttccactaaatttaatatagacaagagccggaaacgaaagcatcttctcttcaacgctgaaaagggaaaaattggcgtgtggctggccaatgatatcaagagatttatgaccgaggagttcaaatctaagtggaaaggttatcaacacacagaattacagaagctgtttgcatactatgacacctcaaagagtgacctagatctcattctgagcgacatggtcatggtgaaagattacccaatcgagcttatagccttggtcaagaaatccaggactctggtggacttcctcaacaagtacctggaagctcgcttagggtatatggagaatgttatcacacgggtgaaaaactctattggaacgccgcagtttaagaccgtaagaaaggagtgcttcactttcctgaaaaagtcgaattacacagtcgtgagccttgataaacaggttgaaaggatcttgtccatgcccctctttattgagcgcggcttcatggacgataagcctaccatgctggaaggcaaatcatatcaacagcacaaggagaagtttgccgactggttcgtgcattacaaagaaaacagtaattatcagaacttttacgatacagaggtctatgagatcactaccgaagacaagcgagagaaagcaaaggtgacgaaaaagataaagcagcaacagaaaaacgatgtattcaccctaatgatggtgaattacatgctggaagaggttctcaagctgtctagcaacgaccggctttccttgaatgaactgtaccagacaaaagaggagcgtattgtcaacaagcaagtggcgaaagacactcaggaaagaaataagaactatatctggaataaagtggtcgatttacagctctgtgaggggctggttaggatcgacaaggtgaaacttaaagatattggaaactttcgcaagtacgaaaatgactcacgggtgaaagagttcctgacctatcagagcgatatcgtatggtctgcttacttgtccaacgaagtcgacagtaataagctctatgtgattgagagacaactggataactacgagagcataaggtctaaagaactactgaaggaggttcaggaaatcgagtgctccgtgtataatcaggtcgccaacaaggagtcactcaaacagagtggtaatgaaaactttaagcaatacgtgctgcagggccttgttccaattgggatggacgtgcgagagatgttgatcctgagcacagatgtaaaattcattaaggaagagatcatacagttaggacaggcaggcgaagtcgagcaagacctctactcgctgatctatattcgcaacaaatttgcccacaatcagcttcccatcaaggagttcttcgatttttgtgaaaacaattaccggtccatttctgacaacgagtattacgctgaatattacatggagatcttcagaagcataaaggaaaaatatacttcatga

SEQ ID NO: 11303 - RNA, 3474 nt, synthetic construct
  misc_feature 1..3474: note = Cas13b variant__Myroides odoratimimus__EKB06014.1__Cas13b
  source 1..3474: mol_type = other RNA
atgaaggacatcctgaccacagatactacggagaaacagaacagattctacagccacaagattgccgacaaatactttttcggcgggtattttaatctcgcttccaacaatatatatgaagtgttcgaggaagtcaacaagaggaatacctttggaaaacttgcaaagcgggataacggtaatctgaagaactacatcattcatgttttcaaagacgagttgtctatctcagattttgaaaagcgcgtggccattttcgcgagttattttcccatcttagagacagtagacaaaaagagcataaaagagcgaaatcgtactatcgatctgaccctatcccaaagaattaggcagttccgggaaatgctcatctctctggtgacagctgtcgaccagcttcgcaacttttacacccactatcatcactcggagattgtgatcgaaaataaggttctggatttcttgaactcaagcctcgtgagtactgccctgcatgtcaaggacaaatacctgaagacagataaaaccaaggagtttctcaaagagacgatagcagccgaattagacattctgatcgaggcttacaagaaaaagcagattgaaaagaaaaatactagattcaaggcaaacaaaagggaggatatccttaatgccatctataacgaggctttctggtcctttattaacgacaaggacaaagataaggagaccgtggtagccaagggcgcggacgcatacttcgagaaaaatcaccacaagtctaacgatcctgactttgccttgaatataagcgaaaaagggatcgtttatctgctatccttctttctcacaaacaaggagatggattcactgaaagctaatcttactggattcaagggcaaggtggaccgggaaagtggtaacagcattaaatacatggccacccaacgcatctattcttttcatacataccgagggctgaagcagaaaataagaacctccgaggaaggagtcaaggagacgttgctcatgcagatgattgatgagctgtcaaaagtgccaaatgtggtctatcagcacttaagcactacacaacagaacagtttcatcgaagactggaatgagtactacaaggattatgaagacgatgttgagaccgacgacctgtctagggtgatccatccggtaattcggaagcgttacgaagatcgctttaactatttcgcaatcagatttctcgacgagttctttgatttccccactcttaggttccaggtgcacctgggcgactacgtccacgatcggcgaacaaaacagttgggcaaggtggagtccgaccgcattataaaagaaaaggttaccgtgtttgctagactaaaagatatcaatagcgccaaggcgtcgtatttccattctctggaggaacaagacaaagaggagctcgataacaagtggacgctgtttcctaatccatcctacgacttccccaaggaacacacccttcagcatcagggggagcaaaagaacgccggaaagattggtatctatgtcaaactgagggatacacagtacaaggaaaaagcagctttggaggaagcccggaagtcactcaatcctaaggagcgcagtgctactaaagccagcaagtacgacatcattacccagataatcgaggcaaacgataacgtgaaatccgaaaagccactggtatttacaggccagcccattgcctatttatctatgaatgacatccacagcatgctgttctcactactcactgacaacgctgagctgaaaaagacccctgaagaggttgaagcgaagttgattgatcaaatcgggaaacagataaatgagatcttgagtaaggacacagataccaaaattctgaagaaatacaaggacaacgatctcaaggagactgacacggataaaatcacaagagacctggcaagggataaggaagagattgaaaaacttatcctggagcagaagcagcgtgccgacgattataattacacctccagcactaaatttaacatagacaagtctcggaaacgaaagcatcttctcttcaatgctgaaaagggaaaaattggcgtgtggctggccaacgatatcaagagatttatgttcaaagagtcaaagagtaaatggaagggttatcaacacaccgagttacagaagctgtttgcatacttcgacacaagcaaatccgacctagaactcattctgtctgatatggtcatggtgaaggactatccaatcgagcttatagatttggtcaggaaatcgcgcaccctggtggactttctcaataagtacctggaagcccggttagggtacatcgagaacgttattactagagtgaaaaatagcatcggaacaccgcagttcaagacggtaaggaaggagtgcttcgcttttctgaaagaatccaactataccgtcgcctcacttgataagcagattgagcgcatcttgagtatgcccctcttcatagaacgaggctttatggactctaaacctactatgctggagggcaagagctaccaacagcacaaagaagatttcgcagactggtttgtgcattataaggaaaattccaactaccagaatttctatgatacagaggtttacgaaattatcaccgaggacaagcgggaacaggcgaaagtgacaaagaaaatcaagcaacagcagaaaaacgatgtctttactctaatgatggtgaactatatgctggaggaagtactcaagctgccatcaaatgaccgtcttagcttgaacgagctgtaccaaaccaaggaggaaagaattgtgaataaacaggttgctaaggacacgcaggagaggaacaaaaattacatctggaacaaggtcgtggatttacagctctgtgaagggctggtgcgcattgacaaagtcaaacttaaagatataggaaatttccggaagtatgagaacgactctagagttaaggaatttctgacctaccaatccgatatcgtgtggagtggttatttgagcaatgaggtggactctaacaaactctacgtaattgagaggcagctggataattatgaatccatccgatcaaaggagctactgaaagaagtccaggagattgagtgcatcgtgtacaaccaggttgccaataaggaaagtctcaaacaaagcggcaacgagaatttcaagcagtatgtgctgcaggggcttttgccccgcggaacagacgtccgggaaatgctgatattatcgactgatgtgaagtttaaaaaggaggaaatcatgcagctcggccaagttagagaggtggagcaggacctgtactcccttatttacatcaggaacaaattcgcacacaaccagctgcctattaaggagttctttgatttctgtgaaaataactatcgtccaatctctgacaatgaatactatgccgagtactatatggaaatatttcgcagcattaaagagaagtacgcttcatga

SEQ ID NO: 11304 - RNA, 3480 nt, synthetic construct
  misc_feature 1..3480: note = Cas13b variant__Myroides odoratimimus__WP_058700060.1__Cas13b
  source 1..3480: mol_type = other RNA
atgaaggacatcctgaccacagatactacggagaaacagaacagattctacagccacaagattgccgacaaatatttcttcggcgggtactttaatctcgcttccaacaatatatatgaagtgttcgaggaagtcaacaagaggaatacctttggaaaacttgcaaagcgggataacggtaatctgaagaactacatcattcatgttttcaaagacgagttgtctatctcagattttgaaaagcgcgtggccattttcgcgagttattttcccatcttagagacagtagacaaaaagagcataaaagagcgaaatcgtactatcgatctgaccctatcccaaagaattaggcagttccgggaaatgctcatctctctggtgacagctgtcgaccagcttcgcaacttttacacccactatcatcactcggatattgtgatcgagaataaggttctggacttcttgaacagctcatttgtgagtactgccctccatgtcaaggataaatacctgaagacagacaaaaccaaggaatttctgaaagagacgatagcagccgagctcgatattttaatcgaggcttacaagaaaaagcagattgagaagaaaaatactagattcaaggcaaacaaaagggaagacatcctgaatgccatctataacgaggctttttggtccttcattaacgacaaggataaagacaaggataaggaaaccgtggtagccaaaggcgcggacgcatactttgagaagaatcaccacaaatctaacgatcctgacttcgcccttaatataagcgagaaggggatcgtttatttgctgtcctttttcctaacaaacaaagaaatggattcactcaaggctaatctgactggatttaagggcaaagtggaccgggagagtggtaacagcattaagtacatggccacccaacgcatctattctttccatacataccgagggcttaaacagaagataagaacctccgaagagggagtcaaagaaacgctgttgatgcagatgattgatgagctctcaaaggtgccaaatgtggtctatcagcacctgagcactacacaacagaacagttttatcgaggactggaatgaatactacaaggattatgaggacgacgttgaaaccgatgacttatctagggtgactcatccggtaatccggaaacgttacgaggatcgcttcaactattttgcaattagattcctggacgaatttttcgatttccccacactcaggtttcaggtgcaccttggcgactacgtccacgatcggcgaaccaagcagctgggcaaagtggagtccgaccgcatcattaaggagaaagttacggtgttcgctagattgaaggatataaatagcgccaaagcgtcgtattttcattctctagaagaacaagacaaggaggaactggataacaagtggaccctcttccctaatccatcctacgactttcccaaagagcacacactgcagcatcagggggaacaaaagaacgccggaaaaatcggtatttatgtcaaacttagggatactcagtacaaagagaaggcagctctggaagaggcccggaagtcattgaatcctaaagaacgcagtgctaccaaggccagcaaatacgacatcatcacacagattatagaggcaaacgacaacgtgaagtccgagaaaccactcgtattcactggccagcccatcgcctatctgtctatgaatgatattcacagcatgttattttcactgctaaccgacaacgctgaactcaagaagacacctgaggaagttgaggcgaaactgatcgatcaaattgggaagcagatcaatgaaatacttagtaaagacaccgatactaagatcttgaaaaagtacaaggacaacgatctgaaagagacggacacagataagattaccagagacctcgcaagggataaagaggaaatcgagaagctgattcttgaacagaaacagcgtgccgacgattataattacacttccagcaccaagttcaacatcgacaaatctcggaagcgaaagcatctgttgtttaatgctgagaaaggaaagataggcgtgtggctcgccaacgacattaaaagattcatgtttaaggaatcaaaaagtaagtggaagggttatcaacacatcgagctgcagaaattattcgcatactttgatacaagcaagtccgacctggagctaattctctctaatatggtcatggtgaaagattatccaatcgaactgatagaccttgtcaagaaatcgaggaccttggtggatttcctgaacaagtacctcgaggcccgcctggaatacatcgagaatgttattactcgggtgaagaacagcatcgggacaccgcagttcaaaacggtaagaaaggagtgctttaccttcttaaagaagtccaattatactgtcgtgtcactggacaaacaggttgaaaggattcttagtatgcccttgtttatcgagcgcggattcatggatgacaagcctacaatgctcgaaggcaagtcttacaaacaacacaaggagaaatttgctgattggttcgtgcattataaggaaaacagcaattaccagaacttttatgacaccgaggtctacgagataacaactgaagataaacgagagaaggccaaggtgaccaaaaagattaaacagcagcaaaagaacgacgtattcacgctgatgatggtgaattatatgctagaagaggttctgaaactctcctcaaacgaccggctgagccttaatgaattgtaccagaccaaggaggagcgtatcgtcaacaaacaggtggcaaaggatacacaagaaagaaataagaactacatctggaataaagtggtcgacctgcagttatgtgatggcctcgttcacattgacaacgtgaagctgaaagatatcgggaattttaggaagtatgagaacgactctcgcgtgaaagagttccttacttaccagtccgatattgtatggagtgcgtatctgagcaatgaagtcgactctaacaagttgtacgtgatagaacggcagctcgataattatgagtccatcagatcaaaggagctgctaaaagaagttcaagagattgaatgcagtgtgtacaaccaggtcgctaataaggagagcctgaaacagtcgggaaacgagaactttaagcagtatgtgctccaaggtctgcttccaatcggcatggacgttagggaaatgttgattctgtccaccgatgtgaaattcaagaaggaggaaatcatacagttagggcaggccggagaggtagaacaggacctctactctctgatctacattcgaaataaattcgcacataaccaacttcccatcaaggagtttttcgatttttgtgagaataactatcgcagcatttcagacaatgaatactatgccgagtactatatggaaatcttccggagtataaaagagaagtacgctaactga

SEQ ID NO: 11305 - RNA, 3465 nt, synthetic construct
  misc_feature 1..3465: note = Cas13b variant__Paludibacter propionicigenes__WP_013446107.1__Cas13b
  source 1..3465: mol_type = other RNA
atgaagaccagcgccaacaatatctacttcaacggcattaattcctttaaaaagatattcgactctaaaggggctatcgcacccattgccgagaagtcatgcagaaactttgatatcaaagcgcagaatgacgtgaacaaggaacaaaggattcactatttcgctgtcggacatacatttaagcagctggatactgagaatctcttcgaatacgttcttgacgagaacctgcgggccaaacgccctacgcgatttatcagtttgcagcagttcgataaggaatttatagagaatatcaaacgtttaattagcgacatcagaaacattaattcccactatatccataggttcgatccactgaagatagacgcagtgccgaccaacattatcgattttctaaaagagtctttcgaactcgccgtaattcaaatctacctgaaggagaagggtatcaattatcttcagttttcggaaaacccccacgctgaccagaaactggtggcattcttgcatgataagttcctccctctggacgagaaaaagacatcaatgctgcagaatgagactccacaactcaaagaatacaaggagtatcggaaatactttaagaccttaagcaagcaggccgctattgatcagctgcttttcgccgaaaaagagacagactacatatggaacttgtttgacagtcaccccgtcctgaccatctccgcgggcaagtatctatctttctacagctgtctctttctgctttccatgttcctgtataaatcagaagcaaaccagttgattagtaagatcaaagggtttaagaagaatactacagaggaggaaaaatccaagcgcgagatattcacctttttctctaaaagatttaactccatggatattgactcagaagagaatcaactcgtgaagttcagggatctgatcttatacctgaaccactatcctgttgcctggaataaagacctcgaacttgatagcagtaacccagctatgacggacaagctgaagtctaaaatcattgagttggagatcaatcggtcctttcccctatacgaaggaaacgagcgcttcgccactttcgcaaagtatcagatttggggcaaaaagcatctgggtaaaagcatagaaaaggagtacatcaatgcttcgtttaccgatgaagagattacagcctacacttatgagaccgacacatgccctgaactcaaggatgcgcacaaaaagctggccgaccttaaagcagctaaggggctgttcggaaaacgaaaggagaaaaacgaatctgatatcaagaagaccgagacgtccatcagagagttgcagcatgaaccaaatccgattaaagacaagctcatacaaaggatcgagaaaaacctgttaactgtgtcatacggccggaatcaggaccgttttatggatttcagtgcccgctttctggctgaaattaactatttcggccaggacgccagctttaagatgtaccacttctatgcaacagatgagcagaatagcgaactagagaaatacgagctccccaaggacaagaaaaagtatgattctctgaaatttcaccaagggaaacttgtccatttcatcagctacaaagaacacttgaagagatacgagtcatgggacgatgcctttgtgattgaaaacaacgctatccagctgaagctcagtttcgacggagtagagaataccgttactatacagagggcgctgcttatctatctgttggaagatgcactccggaacattcagaataacacagccgagaatgctggtaaacaactgttacaggagtactattcccataacaaggccgacctgagcgcatttaaacagatcctaacccagcaagattctattgaacctcagcagaagacggagttcaaaaagctcctgccacgacgccttttgaataactactcacccgccatcaatcatctgcagacccctcacagtagcctcccactgatattagaaaaggctctgcttgccgagaaaagatattgttccttggtggtcaaggcaaaagcggaaggcaactacgacgatttcattaagaggaataaagggaagcaatttaaactccagttcatccggaaggcttggaacctgatgtattttcgcaattcttacctacagaacgtgcaagccgcaggacaccacaagtcgttccatattgagagagacgagtttaatgacttcagcaggtacatgtttgccttcgaagaactgtcccagtataaatactatctcaacgaaatgtttgagaagaaaggcttctttgagaacaatgagttcaagatcctgttccagtcaggtacaagtcttgagaacttgtacgaaaagactaagcagaagtttgagatatggctggcttctaataccgccaaaacaaacaagcccgataattatcacttaaacaattacgaacaacagttcagcaaccagctctttttcatcaatctgtcccattttattaactatcttaaatcaactgggaagctgcagaccgacgcaaatggacaaatcatttacgaggctttgaacaatgtgcagtacctcatcccggagtattactatacagataaacctgaacgtagcgagtctaagtccggcaacaagctgtacaataaactaaaggccaccaaactggaagacgcgctcctgtatgagatggccatgtgctaccttaaggctgataaacagatagcagacaaggccaagcaccccattactaaattgctgacgagtgatgtcgagttcaacatcacaaacaaggaaggcatccagttatatcacctcctggttccatttaaaaagattgacgctttcatcgggcttaaaatgcataaggagcaacaggataagaaacaccctaccagctttctggccaatattgtgaactacctagaactcgtaaagaatgacaaagatatacggaagacttacgaggcattctctaccaaccccgtgaaacgaacactgacctatgacgatttggcgaagatcgacggacatctgatttccaaatcaatcaagtttactaatgtcacattagaactcgagagatacttcatttttaaggaaagtctgatcgtgaaaaagggtaacaatatagacttcaaatatatcaagggccttaggaactactataataacgagaaaaagaagaatgaggggattcgcaacaaagccttccactttggaatcccagatagcaagtcgtacgaccagctgattcgggatgctgaagttatgttcatcgccaatgaggtgaaacccacgcatgcaaccaagtatactgacttgaacaaacaactccacacagtctgtgataagctgatggaaaccgtgcacaatgactacttttccaaggagggcgatggtaaaaagaaaagagaggctgccgggcagaagtacttcgaaaacataatttctgcaaaatga

SEQ ID NO: 11306 - RNA, 3396 nt, synthetic construct
  misc_feature 1..3396: note = Cas13b variant__Phaeodactylibacter xiamenensis__WP_044218239.1__Cas13b
  source 1..3396: mol_type = other RNA
atgaccaacacacccaagagaaggactctgcaccggcatcctagctacttcggcgcctttctcaatatcgctcgccacaacgcattcatgattatggagcatctttccacgaaatatgacatggaagataagaataccctggacgaggcccagttgccaaacgcgaaattatttgggtgcctgaagaaacgatacggaaagccggatgtgacagaaggtgtctctcgtgacctaagaaggtatttcccctttctcaattaccctctgttccttcacctggagaagcaacagaacgctgaacaggccgcaacttatgatataaatccagaggacatcgagtttaccttgaaaggcttctttcggctcctgaaccagatgcgcaataactactcacattatattagtaatacagattacgggaagttcgacaaactgcccgttcaagatatctacgaagccgctatttttagactcttagacaggggaaagcacaccaaacggttcgatgtgtttgagagcaagcacactcgccatctggaatccaacaattctgagtatcgacctagatcgcttgcaaactcaccagaccacgagaatacagtagccttcgtgacctgtttgttcctggaaaggaagtacgcttttcccttcctaagccggctcgattgctttcgtagtacgaacgacgccgcggagggcgaccctctgatccgcaaagcatcccatgaatgttatactatgttctgctgtagacttccacagccgaagctggagtctagcgatatattgctcgacatggtcaacgaactgggtaggtgcccctccgccttatacaatctgctctcagaggaggatcaggctcggtttcacatcaaacgagaagagattaccgggttcgaagaggaccctgatgaggaacttgagcaggaaatcgtgctgaagcgccacagtgacagatttccatatttcgccttgaggtactttgatgacacagaggcattccaaactctacggtttgatgtttatctgggacgctggagaaccaaacccgtgtacaagaaaaggatttacggccaggaacgtgaccgggtcctcacacagagcatccgaaccttcacgagactgtctaggcttctgcctatatatgagaacgtgaagcatgatgctgtacgccagaatgaagaggacggcaagttggttaacccagacgtgacttcccaatttcacaaatcatggattcagatcgagagcgatgaccgggccttcctcagtgatagaattgaacatttctctccccactacaattttggggaccaggtcatcggactgaagttcatcaacccggataggtatgcggccattcaaaatgtgtttcctaaattacccggtgaggaaaagaaagacaaggatgcaaagctggtgaacgagacagctgacgccataatctccacccatgagattcgcagcctattcctctaccactatctgtcgaaaaagccaatctctgctggcgatgaacgacggtttatacaggtcgacactgagacattcattaaacagtacatcgataccatcaaacttttcttcgaagacattaaatccggggagttgcagcctatcgccgatcccccaaattatcaaaagaacgaacccctgccttacgttcgtggagacaaggagaaaacgcaggaggaaagagcacagtacagggagcgccagaaggaaattaaagagcggagaaaggaactcaataccctgcttcaaaacaggtatggcctgtcaatacagtacatcccaagtcgattgcgcgagtatctcctgggttacaaaaaggtgccgtatgagaagttagccctgcagaaactacgggctcagagaaaggaagtaaagaagaggattaaagacatcgagaagatgcgtacaccccgcgtgggggaacaagcgacttggctcgcagaggatatcgtctttctgacccctccaaaaatgcacacacccgaacggaagactaccaagcatcctcagaaacttaataacgaccagttcagaattatgcagagctccttggcctacttttctgtgaataagaaagctataaagaaattctttcaaaaggagacaggaatcggcctgagcaacagggagacctcacacccattcctctatcgaattgatgttggccggtgtcgcgggatcctggacttctacactggatacttaaagtataaaatggattggctggacgatgccattaagaaagtggacaacagaaagcatggtaaaaaggaagcaaagaaatacgagaagtatcttcccagttccatccagcacaaaacgccgttggaactcgattacacaaggctgcctgtctatctaccacggggcctgtttaagaaagccatagtgaaggctctcgccgcacacgcggacttccaggtagagcccgaggaagataatgttatcttttgcctggaccaacttttggatggggacacccaggacttctacaactggcagcgatattacagaagcgctctgactgagaaggaaaccgataatcagttagtgctcgcccatccttacgcagagcaaattctgggaacaatcaaaacccttgaaggcaagcagaaaaacaataagctgggtaacaaagccaagcagaaaattaaggacgagttgatcgatctcaagcgcgctaaaaggcgtctgctagaccgggagcagtatctgagagccgtccaagcagaagatagggctctctggctgatgatacaggagcgccagaagcagaaagccgaacacgaggaaattgcgtttgaccaacttgatttgaagaatatcactaaaattctgacagagtctatcgacgcccgattaagaatacccgatacgaaggtggacatcaccgataagctcccactgcggaggtacggggaccttcgccgtgtcgctaaagacagacggctggtgaacctagcatcatattaccatgttgccggcctcagtgagattccttatgatctggtgaagaaagaattggaggaatacgacaggcgccgagtagctttctttgagcacgtctatcagttcgaaaaggaggtgtacgatagatacgccgcagagctgcggaatgaaaaccccaaaggagagagcacttatttttcccattgggaatacgttgcggtggccgtcaagcactctgctgacacacacttcaatgagttatttaaggagaaagtgatgcagctcaggaacaagttccatcacaatgaatttccatattttgattggctgcttccggaggtagaaaaagcctcggcagctctgtacgccgaccgcgtgttcgatgttgcagagggctattaccaaaagatgagaaaattgatgaggcagtga

SEQ ID NO: 11307 - RNA, 3408 nt, synthetic construct
  misc_feature 1..3408: note = Cas13b variant__Porohyromonas gingivalis__WP_012458151.1__Cas13b
  source 1..3408: mol_type = other RNA
atgaacaccgtgcccgccagcgagaataagggccagtcccgtacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgtgtttttcaagccagacgactttgttttggccaaaaatcggaaggagcagctgattagtgtcgcagatggtaaagagtgcctaacagtgagcgggttcgcctttttcatctgtctcttcctggaccgcgaacaggcttctggaatgctttcccgaataagaggctttaagaggaccgatgagaactgggcacgggccgtacacgaaactttctgcgacctgtgtatccgtcatccccacgatcgcttggagtcaagcaatacaaaggaagctctcctgttagacatgctgaacgagctcaatagatgccctaggattctttatgatatgctgccagaggaggagcgggcccagtttttgcccgcgctagacgaaaacagtatgaataacctgtctgaaaattccctcgatgaagagagccgactgctttgggacggctcgtctgattgggcagaggccctgaccaaacgcatcagacatcaagacaggttcccttacttgatgctccggtttattgaagagatggacctgttaaaggggatccgcttcagagttgatctgggagaaatagagctagactcctacagtaaaaaggtgggtaggaacggcgaatatgatcgtacgattactgaccacgctctcgcctttgggaaactgtcagatttccagaacgaggaggaagtcagccggatgatctccggagaggcatcttacccagtgcgatttagccttttcgctccgagatatgccatttacgacaataagatcggctattgtcacacctcagatcccgtgtaccctaaaagtaagacaggtgaaaagagggcgttgtccaacccacagagcatggggtttatctctgtccatgacctgcgcaaactcctgcttatggagctgttgtgcgagggatcattcagtcggatgcagagcgattttctcagaaaggccaataggattctggacgaaactgcagagggcaaattacaattctccgctctgttccccgaaatgcgccaccgatttatacctccacagaaccccaagtctaaagatcggcgtgagaaggccgaaaccacactagagaagtataaacaggagatcaagggcagaaaagacaagctcaattcgcaactgcttagcgctttcgatatggaccagaggcagttgccgtcccgcctgctcgacgaatggatgaacattcggcctgcctcacatagtgttaaactgagaacctacgtgaagcagttaaatgaggattgtaggctgcgacttcgcaagtttcggaaagacggggatggaaaggcaagagccatccccttggtaggtgaaatggctacgttcctctctcaagacatagtgaggatgattatcagcgaggaaactaaaaagctgatcacatccgcgtactataacgagatgcagcgttcactagcacagtacgccggcgaggaaaatcgccggcagtttagagctattgtcgccgagctgaggctcctggatccaagctctgggcaccctttcctttccgcaaccatggaaactgcccatcgatatacagagggattttacaaatgctatttggaaaagaagcgggagtggctggctaaaatcttctaccgccccgagcaagacgaaaacaccaagagaaggattagtgtgtttttcgttccagatggcgaggcccggaaattactccccctgcttatacgaagacgcatgaaggaacagaatgacctgcaggattggatcaggaacaaacaggcacaccctattgacttgccaagccacctctttgattctaaggtgatggagctgctaaaagtcaaggacggtaagaaaaagtggaatgaggcgttcaaagattggtggtccacgaagtatccggacgggatgcaacccttttacggcctgcgtcgggaactcaacatccatggaaaatcagtgagttacatccctagcgacggcaagaagttcgctgattgttatacccacctgatggagaaaacagtaagagacaagaaaagggaacttcgcactgccgggaagccagttccccctgatttggcagccgacattaaacgatcgttccatagagctgtgaatgagcgggaatttatgctgaggttagtccaggaggatgaccgcctcatgctgatggccataaacaagatgatgaccgatcgtgaggaagacatccttccaggactgaagaacattgattccatcctagacgaggaaaatcagttctctctcgcagtgcacgctaaagtcctggagaaggaaggtgagggcggggataacagcttgtcactggtgcccgccacaattgagatcaaaagtaagagaaaagactggtccaagtacatacggtataggtacgaccgccgagttccgggattaatgtctcactttcctgaacataaggcgactctcgatgaggtgaaaaccctgcttggcgaatatgacagatgccggatcaagattttcgattgggcctttgctctggagggtgcaatcatgagcgacagggatttgaaaccatacctccacgaatcctcaagccgcgaggggaagagtggcgagcattctacactggtaaaaatgctagtcgaaaagaaaggatgcctgacccccgacgagtcccagtatcttattctcatcagaaataaggccgctcacaaccaattcccttgtgccgcagaaatgcccctgatatacagggatgtgagcgcgaaggttggctcgattgaggggtcatctgccaaagacttgccagagggaagttccctggtggatagcttatggaagaaatacgaaatgatcattcggaagatcctccctatactggaccccgagaatagatttttcggtaaacttctgaacaatatgtctcagccaatcaacgatttgtga

SEQ ID NO: 11308 - RNA, 3408 nt, synthetic construct
  misc_feature 1..3408: note = Cas13b variant__Porohyromonas gingivalis__ERJ81987.1__Cas13b
  source 1..3408: mol_type = other RNA
atgaacaccgtgcccgccagcgagaataagggccagtccagaacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgactttttcaagccagacgattttgttttggccaaaaatcggaaggagcagctgattagtgtggcagacggtaaagagtgcctaacagtcagcgggctcgccttctttatctgtctgttccttgatcgcgaacaggcttctggaatgctgtcccgaataagaggcttcaagaggaccgacgagaactgggcacgggccgtgcacgaaactttttgcgatttgtgtatccgtcatccccacgaccgcctcgagtcaagcaatacaaaggaagctctgttactggatatgctcaacgagcttaatagatgccctaggattctgtatgacatgttgccagaggaggagcgggcccagttcctacccgcgctggatgaaaacagtatgaataacctctctgaaaattccctgaacgaagagagccgacttctgtgggacggctcgtctgattgggcagaggccttgaccaaacgcatcagacatcaagacaggtttccttacctcatgctgcggttcattgaagagatggacttactgaaggggatccgctttagagtagatctaggagaaatagagctcgactcctacagtaaaaaggttggtaggaacggcgaatatgatcgtacgattactgaccacgctctggccttcgggaaactttcagattttcagaatgaggaggaagtgagccggatgatctccggagaggcatcttacccagtccgattcagcttgtttgctccgagatatgccatttacgacaacaagatcggctattgtcacacctcagatcccgtgtaccctaaaagtaagacaggtgaaaagagggcgctgtccaatccacagagcatggggttcatctctgtgcatgacctccgcaaactgcttctgatggagttgctctgcgagggatcatttagtcggatgcagagcggcttcctgagaaaggccaacaggattttagatgaaactgcagagggcaaactgcaattttccgctctattccccgaaatgcgccaccgattcatacctccacagaatcccaagtctaaagaccggcgtgagaaggccgaaaccacactcgagaagtataaacaggagatcaaggggagaaaagataagctgaactcgcaacttttgagcgcttttgacatgaatcagaggcagctgccgtcccgcctcctggatgaatggatgaacattcggcctgcctcacatagtgtcaaattaagaacctacgttaagcagctgaatgaggactgtaggcttcgattgcgcaagttccggaaagacggagatggtaaggcaagagccatccccctcgtgggcgaaatggctacgtttctgtctcaagacatagtaaggatgattatcagcgaggaaactaaaaagctaatcacatccgcgtactataacgagatgcagcgttcactggcacagtacgccggggaggaaaatcgccggcagttcagagctattgtggccgagctccatctgcttgatccaagctctggacaccctttcttgtccgcaaccatggaaactgcccacaggtatacagaggacttctacaaatgctatctggaaaagaagcgagagtggttagctaaaaccttttaccggcccgagcaagatgaaaacacgaagcgcagaatcagtgtcttctttgtgccagacggcgaggccaggaaactcctgccccttctgattcggcgaagaatgaaggaacagaatgatttgcaggactggatacgcaacaaacaggcacaccctatcgatctcccaagccatctgttcgactctaagattatggagctactgaaagttaaggatggtaagaaaaagtggaatgaggcgtttaaagactggtggtccaccaagtatccggatgggatgcaacccttctacggcctcaggcgtgaactgaacatccacggaaaatcagtgagttacatccctagcgacggcaagaagtttgctgactgttatacacatcttatggagaaaactgtccaggataagaaacgggaattgagaaccgccgggaagccagtgccccctgacctggcagccgatattaaaaggtcgttccaccgcgctgtaaacgagcgagaatttatgttaagactcgttcaggaggacgatcggctgatgcttatggccataaataagatgatgacagacagggaggaagatatcctgccaggactaaagaacattgactccatcctcgatgaggaaaatcagttttctctggcagtgcacgctaaagtcttggagaaggaaggtgagggcggggacaacagcctgtcattagtgcccgccactattgagatcaaaagtaagcgcaaagattggtccaagtacatacgttatagatacgaccggagggtcccgggactcatgtctcatttccctgaacacaaggcgaccctggacgaggtgaaaacacttctgggcgaatatgatcgctgccgaatcaagatttttgactgggccttcgctttggagggtgcaatcatgagcgatagagacctcaaaccatacctgcatgaatcctcaagccgggaggggaagagtggcgagcactctaccctagttaaaatgctggtggaaaagaaaggatgccttactcccgatgagtcccaatatctcattctgatcaggaataaggccgctcataaccagtttccttgtgccgcagaaatgcccttgatataccgcgacgtaagcgcgaaggtcggctcgattgaggggtcatctgccaaagatctgccagagggaagttccttagtggacagcctctggaagaaatacgaaatgatcattagaaagatcctgcctatacttgatcacgagaataggttctttggtaaactgttgaacaatatgtctcagcccatcaacgacctctga

SEQ ID NO: 11309 - RNA, 3408 nt, synthetic construct
  misc_feature 1..3408: note = Cas13b variant__Porohyromonas gingivalis__ERJ65637.1__Cas13b
  source 1..3408: mol_type = other RNA
atgaacaccgtgcccgccagcgagaataagggccagtccagaacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgactttttcaagccagacgattttgttttggccaaaaatcggaaggagcagctgattagtgtggcagacggtaaagagtgcctaacagtcagcgggctcgccttctttatctgtctgttccttgatcgcgaacaggcttctggaatgctgtcccgaataagaggcttcaagaggaccgacgagaactgggcacgggccgtgcacgaaactttttgcgatttgtgtatccgtcatccccacgaccgcctcgagtcaagcaatacaaaggaagctctgttactggatatgctcaacgagcttaatagatgccctaggattctgtatgacatgttgccagaggaggagcgggcccagttcctacccgcgctggatgaaaacagtatgaataacctctctgaaaattccctgaacgaagagagccgacttctgtgggacggctcgtctgattgggcagaggccttgaccaaacgcatcagacatcaagacaggtttccttacctcatgctgcggttcattgaagagatggacttactgaaggggatccgctttagagtagatctaggagaaatagagctcgactcctacagtaaaaaggttggtaggaacggcgaatatgatcgtacgattactgaccacgctctggccttcgggaaactttcagattttcagaatgaggaggaagtgagccggatgatctccggagaggcatcttacccagtccgattcagcttgtttgctccgagatatgccatttacgacaacaagatcggctattgtcacacctcagatcccgtgtaccctaaaagtaagacaggtgaaaagagggcgctgtccaatccacgcagcatggggttcatctctgtgcatgacctccggaaactgcttctgatggagttgctctgcgagggatcatttagtagaatgcagagcgatttcctgaggaaggccaaccgcattttagacgaaactgcagagggcaaactgcagttttccgctctattccccgaaatgcgacaccggttcatacctccacaaaatcccaagtctaaagatcgtagagagaaggccgaaaccacactcgagaagtataaacaggagatcaagggcaggaaagacaagctgaactcgcagcttttgagcgcttttgatatggaccaacgccagctgccgtcccggctcctggacgaatggatgaatattagacctgcctcacatagtgtcaaattaaggacctacgttaagcagctgaacgaggattgtcgacttcgcttgcagaagttccggaaagacggggatggaaaggcaagagccatccccctcgtgggtgaaatggctacgtttctgtctcaagacatagtaaggatgattatcagcgaggaaactaaaaagctaatcacatccgcgtactataatgagatgcagcgttcactggcacagtacgccggcgaggaaaaccgccaccagttccgggctattgtggccgagctcagactgcttgatccaagctctgggcatcctttcttgtccgcaaccatggaaactgcccacaggtatacagaggacttctacaaatgctatctggaaaagaagcgagagtggttagctaaaaccttttaccggcccgagcaagatgaaaatacgaagcgcagaatcagtgtcttctttgtgccagacggagaggccaggaaactcctgccccttctgattcggcgaagaatgaaggaacagaacgatttgcaggactggatacgcaataaacaggcacaccctatcgatctcccaagccatctgttcgactctaagattatggagctactgaaagttaaggatggcaagaaaaagtggaacgaggcgtttaaagactggtggtccaccaagtatccggacggtatgcaacccttctacgggctcaggcgtgaactgaatatccacggcaaatcagtgagttacatccctagcgatggaaagaagtttgctgactgttatacacatcttatggagaaaactgtccaggataagaaacgggaattgagaaccgccggcaagccagtgccccctgacctggcagccgatattaaaaggtcgttccaccgcgctgtaaacgagcgagaatttatgttaagactcgttcaggaggacgatcggctgatgcttatggccataaacaagatgatgacagacagggaggaagatatcctgccagggctaaagaatattgactccatcctcgatgaggaaaaccagttttctctggcagtgcacgctaaagtcttggagaaggaaggagagggtggcgacaatagcctgtcattagtgcccgccactattgagatcaaaagtaagcgcaaagactggtccaagtacatacgttatagatacgatcggagggtcccggggctcatgtctcatttccctgaacacaaggcgaccctggacgaggtgaaaacacttctgggagaatatgatcgctgccgaatcaagatttttgactgggccttcgctttggagggcgcaatcatgagcgatagagacctcaaaccatacctgcatgaatcctcaagccgggagggtaagagtggggagcactctaccctagttaaaatgctggtggaaaagaaaggctgccttactcccgatgagtcccaatatctcattctgatcaggaacaaggccgctcataatcagtttccttgtgccgcagaaatgcccttgatataccgcgacgtaagcgcgaaggtcggatcgattgagggctcatctgccaaagatctgccagaggggagttccttagtggacagcctctggaagaaatacgaaatgatcattagaaagatcctgcctatacttgatcccgagaacaggttctttggaaaactgttgaataacatgtctcagccaatcaatgacctctga

SEQ ID NO: 11310 - RNA, 3408 nt, synthetic construct
  misc_feature 1..3408: note = Cas13b variant__Porohyromonas gingivalis__WP_021665475.1__Cas13b
  source 1..3408: mol_type = other RNA
atgaacaccgtgcccgccagcgagaataagggccagtccagaacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgactttttcaagccagacgattttgttttggccaaaaatcggaaggagcagctgattagtgtggcagacggtaaagagtgcctaacagtcagcgggctcgccttctttatctgtctgttccttgatcgcgaacaggcttctggaatgctgtcccgaataagaggcttcaagaggaccaacgagaattgggcacgggccgtgcacgaaactttttgcgacttgtgtatccgtcatccccacgatcgcctcgagtcaagcaacacaaaggaagctctgttactggacatgctcaatgagcttaacagatgccctaggattctgtatgatatgttgccagaggaagaacgggcccagttcctacccgcgctggacgaaaatagtatgaacaatctctctgagaactccctgaacgaagagagccgacttctgtgggatggctcgtctgactgggcagaggccttgaccaaacgcatcagacatcaagataggtttccttacctcatgctgcggttcattgaagagatggacttactgaaggggatccgctttagagtagacctaggagaaatagagctcgattcctacagtaaaaaggttggtaggaatggcgaatatgaccgtacgattactgatcacgctctggccttcgggaaactttcagactttcagaacgaggaggaagtgagccggatgatctccggagaggcatcttacccagtccgattcagcttgtttgctccgagatatgccatttacgataataagatcggctattgtcacacctcagaccccgtgtaccctaaaagtaagacaggtgaaaagagggcgctgtccaacccacagagcatggggttcatctctgtgcatgatctccgcaaactgcttctgatggagttgctctgcgagggatcatttagtcggatgcagagcggcttcctgagaaaggccaataggattttagacgaaactgcagagggcaaactgcaattttccgctctattccccgaaatgcgccaccgattcatacctccacagaaccccaagtctaaagatcggcgtgagaaggccgaaaccacactcgagaagtataaacaggagatcaaggggagaaaagacaagctgaactcgcaacttttgagcgcttttgatatgaatcagaggcagctgccgtcccgcctcctggacgaatggatgaatattcggcctgcctcacatagtgtcaaattaagaacctacgttaagcagctgaacgaggattgtaggcttcgattgcgcaagttccggaaagacggagacggtaaggcaagagccatccccctcgtgggcgaaatggctacgtttctgtctcaagatatagtaaggatgattatcagcgaggaaactaaaaagctaatcacatccgcgtactataatgagatgcagcgttcactggcacagtacgccggggaggaaaaccgccggcagttcagagctattgtggccgagctccacttgcttgacccaagctctggacatccttttctgtccgcaaccatggaaactgcccacaggtatacagaggatttctacaaatgctatctggaaaagaagcgagagtggttagctaaaaccttttaccggcccgagcaagacgaaaatacgaagcgcagaatcagtgtcttctttgtgccagatggcgaggccaggaaactcctgccccttctgattcggcgaagaatgaaggaacagaacgacttgcaggattggatacgcaataaacaggcacaccctatcgacctcccaagccatctgttcgattctaagattatggagctactgaaagttaaggacggtaagaaaaagtggaacgaggcgtttaaagattggtggtccaccaagtatccggacgggatgcaacccttctacggcctcaggcgtgaactgaacatccacggaaaatcagtgagttacatccctagcgatggcaagaagtttgctgactgttatacacatcttatggagaaaactgtccaggacaagaaacgggaattgagaaccgccgggaagccagtgccccctgatctggcagccgacattaaaaggtcgttccaccgcgctgtaaatgagcgagagttcatgttaagactcgttcaggaggatgaccggctgatgcttatggccataaacaagatgatgacagatagggaggaagacatcctgccaggactaaagaatattgattccatcctcgacaaagagaaccagttttctctggcagtgcacgctaaggtcttggaaaaagagggtgaaggcggggataatagcctgtcattagtgcccgccactattgagatcaagagtaaacgcaaggactggtccaagtacatacgttatagatacgatcggagggtcccgggactcatgtctcatttccctgagcacaaagcgaccctggacgaagtgaagacacttctgggcgagtatgaccgctgccgaatcaaaatttttgattgggccttcgctttggaaggtgcaatcatgagcgacagagatctcaagccatacctgcatgagtcctcaagccgggaagggaaaagtggcgagcactctaccctagttaagatgctggtggagaaaaagggatgccttactcccgacgaatcccaatatctcattctgatcaggaacaaggccgctcataatcagtttccttgtgccgcagagatgcccttgatataccgcgatgtaagcgcgaaagtcggctcgattgaagggtcatctgccaaggacctgccagagggaagttccttagtggatagcctctggaaaaagtacgagatgatcattagaaaaatcctgcctatacttgaccacgaaaacaggttctttggtaagctgttgaataacatgtctcagcccatcaatgatctctga

SEQ ID NO: 11311 - RNA, 3408 nt, synthetic construct
  misc_feature 1..3408: note = Cas13b variant__Porohyromonas gingivalis__WP_061156637.1__Cas13b
  source 1..3408: mol_type = other RNA
atgaacaccgtgcccgccagcgagaataagggccagtccagaacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgactttttcaagccagacgattttgttttggccaaaaatcggaaggagcagctgattagtgtggcagacggtaaagagtgcctaacagtcagcgggctcgccttctttatctgtctgttccttgatcgcgaacaggcttctggaatgctgtcccgaataagaggcttcaagaggaccgacgagaactgggcacgggccgtgcacgaaactttttgcgatttgtgtatccgtcatccccacgaccgcctcgagtcaagcaatacaaaggaagctctgttactggatatgctcaacgagcttaatagatgccctaggattctgtatgacatgttgccagaggaggagcgggcccagttcctacccgcgctggatgaaaacagtatgaataacctctctgaaaattccctgaacgaagagagccgacttctgtgggacggctcgtctgattgggcagaggccttgaccaaacgcatcagacatcaagacaggtttccttacctcatgctgcggttcattgaagagatggacttactgaaggggatccgctttagagtagatctaggagaaatagagctcgactcctacagtaaaaaggttggtaggaacggcgaatatgatcgtacgattactgaccacgctctggccttcgggaaactttcagattttcagaatgaggaggaagtgagccggatgatctccggagaggcatcttacccagtccgattcagcttgtttgctccgagatatgccatttacgacaacaagatcggctattgtcacacctcagatcccgtgtaccctaaaagtaagacaggtgaaaagagggcgctgtccaatccacagagcatggggttcatctctgtgcatgacctccgcaaactgcttctgatggagttgctctgcgagggatcatttagtcggatgcagagcggcttcctgagaaaggccaacaggattttagatgaaactgcagagggcaaactgcaattttccgctctattccccgaaatgcgccaccgattcatacctccacagaatcccaagtctaaagaccggcgtgagaaggccgaaaccacactcgagaagtataaacaggagatcaaggggagaaaagataagctgaactcgcaacttttgagcgcttttgacatgaatcagaggcagctgccgtcccgcctcctggatgaatggatgaacattcggcctgcctcacatagtgtcaaattaagaacctacgttaagcagctgaatgaggactgtaggcttcgattgcgcaagttccggaaagacggagatggtaaggcaagagccatccccctcgtgggcgaaatggctacgtttctgtctcaagacatagtaaggatgattatcagcgaggaaactaaaaagctaatcacatccgcgtactataacgagatgcagcgttcactggcacagtacgccggggaggaaaatcgccggcagttcagagctattgtggccgagctccatctgcttgatccaagctctggacaccctttcttgtccgcaaccatggaaactgcccacaggtatacagaggacttctacaaatgctatctggaaaagaagcgagagtggttagctaaaaccttttaccggcccgagcaagatgaaaacacgaagcgcagaatcagtgtcttctttgtgccagacggcgaggccaggaaactcctgccccttctgattcggcgaagaatgaaggaacagaatgatttgcaggactggatacgcaacaaacaggcacaccctatcgatctcccaagccatctgttcgactctaagattatggagctactgaaagttaaggatggtaagaaaaagtggaatgaggcgtttaaagactggtggtccaccaagtatccggatgggatgcaacccttctacggcctcaggcgtgaactgaacatccacggaaaatcagtgagttacatccctagcgacggcaagaagtttgctgactgttatacacatcttatggagaaaactgtccaggataagaaacgggaattgagaaccgccgggaagccagtgccccctgacctggcagccgatattaaaaggtcgttccaccgcgctgtaaacgagcgagaatttatgttaagactcgttcaggaggacgatcggctgatgcttatggccataaataagatgatgacagacagggaggaagatatcctgccaggactaaagaacattgactccatcctcgataaagagaatcagttttctctggcagtgcacgctaaggtcttggaaaaagagggtgaaggcggggacaacagcctgtcattagtgcccgccactattgagatcaagagtaaacgcaaggattggtccaagtacatacgttatagatacgaccggagggtcccgggactcatgtctcatttccctgagcacaaagcgaccctggacgaagtgaagacacttctgggcgagtatgatcgctgccgaatcaaaatttttgactgggccttcgctttggaaggtgcaatcatgagcgatagagacctcaagccatacctgcatgagtcctcaagccgggaagggaaaagtggcgagcactctaccctagttaagatgctggtggagaaaaagggatgccttactcccgatgaatcccaatatctcattctgatcaggaataaggccgctcataaccagtttccttgtgccgcagagatgcccttgatataccgcgacgtaagcgcgaaagtcggctcgattgaagggtcatctgccaaggatctgccagagggaagttccttagtggacagcctctggaaaaagtacgagatgatcattagaaaaatcctgcctatacttgatcccgaaaataggttctttggtaagctgttgaacaatatgtctcagccaatcaacgacctctga

SEQ ID NO: 11312 - RNA, 3408 nt, synthetic construct
  misc_feature 1..3408: note = Cas13b variant__Porohyromonas gingivalis__WP_023846767.1__Cas13b
  source 1..3408: mol_type = other RNA
atgaacaccgtgcccgccagcgagaataagggccagtccagaacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgactttttcaagccagacgattttgttttggccaaaaatcggaaggagcagctgattagtgtggcagacggtaaagagtgcctaacagtcagcgggctcgccttctttatctgtctgttccttgatcgcgaacaggcttctggaatgctgtcccgaataagaggcttcaagaggaccgacgagaactgggcacgggccgtgcacgaaactttttgcgatttgtgtatccgtcatccccacgaccgcctcgagtcaagcaatacaaaggaagctctgttactggatatgctcaacgagcttaatagatgccctaggattctgtatgacatgttgccagaggaggagcgggcccagttcctacccgcgctggatgaaaacagtatgaataacctctctgaaaattccctgaacgaagagagccgacttctgtgggacggctcgtctgattgggcagaggccttgaccaaacgcatcagacatcaagacaggtttccttacctcatgctgcggttcattgaagagatggacttactgaaggggatccgctttagagtagatctaggagaaatagagctcgactcctacagtaaaaaggttggtaggaacggcgaatatgatcgtacgattactgaccacgctctggccttcgggaaactttcagattttcagaatgaggaggaagtgagccggatgatctccggagaggcatcttacccagtccgattcagcttgtttgctccgagatatgccatttacgacaacaagatcggctattgtcacacctcagatcccgtgtaccctaaaagtaagacaggtgaaaagagggcgctgtccaatccacgcagcatggggttcatctctgtgcatgacctccggaaactgcttctgatggagttgctctgcgagggatcatttagtagaatgcagagcgatttcctgaggaaggccaaccgcattttagacgaaactgcagagggcaaactgcagttttccgctctattccccgaaatgcgacaccggttcatacctccacaaaatcccaagtctaaagatcgtagagagaaggccgaaaccacactcgagaagtataaacaggagatcaagggcaggaaagacaagctgaactcgcagcttttgagcgcttttgatatgaatcaacgccagctgccgtcccggctcctggacgaatggatgaacattagacctgcctcacatagtgtcaaattaaggacctacgttaagcagctgaatgaggactgtcgacttcgcttgcggaagttcagaaaagatggggacggaaaggcaagggccatccccctcgtgggtgaaatggctacgtttctgtctcaggatatagtacgtatgattatcagcgaggaaactaaaaagctaatcacatccgcgtactataacgagatgcaacgctcactggcacagtacgccggcgaggaaaatcggagacagttcagggctattgtggccgagctccatctgcttgacccaagctctgggcaccctttcttgtccgcaaccatggaaactgcccaccgatatacagaggatttctacaaatgctatctggaaaagaagcgggagtggttagctaaaaccttttaccgccccgagcaggacgaaaacacgaagagaaggatcagtgtcttctttgtgccagatggagaggcccggaaactcctgccccttctgattcgaagacgcatgaaggaacaaaatgacttgcaggattggataaggaacaaacaggcacaccctatcgacctcccaagccatctgttcgattctaagattatggagctactgaaagttaaggacggcaagaaaaagtggaatgaggcgtttaaagattggtggtccaccaagtatccggacggtatgcagcccttctacgggctccgtcgggaactgaacatccacggcaaatcagtgagttacatccctagcgacggaaagaagtttgctgattgttatacacatcttatggagaaaactgtccaagacaagaaaagagaattgaggaccgccggcaagccagtgccccctgatctggcagccgacattaaacgctcgttccaccgagctgtaaacgagagagaatttatgttacggctcgttcaggaggatgacaggctgatgcttatggccataaataagatgatgacagatcgcgaggaagacatcctgccagggctaaagaacattgattccatcctcgacgaggaaaatcagttttctctggcagtgcacgctaaagtcttggagaaggaaggagagggtggcgataacagcctgtcattagtgcccgccactattgagatcaaaagtaagcgtaaagactggtccaagtacataagatatcggtacgacaggcgcgtcccggggctcatgtctcatttccctgaacacaaggcgaccctggatgaggtgaaaacacttctgggagaatatgaccgatgcagaatcaagatttttgattgggccttcgctttggagggcgcaatcatgagcgaccgggatctcaaaccatacctgcatgaatcctcaagcagggagggtaagagtggggagcactctaccctagttaaaatgctggtggaaaagaaaggctgccttactcccgacgagtcccagtatctcattctgatccgcaataaggccgctcataaccaatttccttgtgccgcagaaatgcccttgatatacagagatgtaagcgcgaaggtcggatcgattgagggctcatctgccaaagacctgccagaggggagttccttagtggatagcctctggaagaaatacgaaatgatcattaggaagatcctgcctatacttgaccccgagaatcggttctttggaaaactgttgaacaatatgtctcagccaatcaacgatctctga

SEQ ID NO: 11313 - RNA, 3408 nt, synthetic construct
  misc_feature 1..3408: note = Cas13b variant__Porohyromonas gingivalis__ERJ87335.1__Cas13b
  source 1..3408: mol_type = other RNA
atgaacaccgtgcccgccagcgagaataagggccagtccagaacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgactttttcaagccagacgattttgttttggccaaaaatcggaaggagcagctgattagtgtggcagacggtaaagagtgcctaacagtcagcgggctcgccttctttatctgtctgttccttgatcgcgaacaggcttctggaatgctgtcccgaataagaggcttcaagaggaccgacgagaactgggcacgggccgtgcacgaaactttttgcgatttgtgtatccgtcatccccacgaccgcctcgagtcaagcaatacaaaggaagctctgttactggatatgctcaacgagcttaatagatgccctaggattctgtatgacatgttgccagaggaggagcgggcccagttcctacccgcgctggatgaaaacagtatgaataacctctctgaaaattccctgaacgaagagagccgacttctgtgggacggctcgtctgattgggcagaggccttgaccaaacgcatcagacatcaagacaggtttccttacctcatgctgcggttcattgaagagatggacttactgaaggggatccgctttagagtagatctaggagaaatagagctcgactcctacagtaaaaaggttggtaggaacggcgaatatgatcgtacgattactgaccacgctctggccttcgggaaactttcagattttcagaatgaggaggaagtgagccggatgatctccggagaggcatcttacccagtccgattcagcttgtttgctccgagatatgccatttacgacaacaagatcggctattgtcacacctcagatcccgtgtaccctaaaagtaagacaggtgaaaagagggcgctgtccaatccacgcagcatggggttcatctctgtgcatgacctccggaaactgcttctgatggagttgctctgcgagggatcatttagtagaatgcagagcgatttcctgaggaaggccaaccgcattttagacgaaactgcagagggcaaactgcagttttccgctctattccccgaaatgcgacaccggttcatacctccacaaaatcccaagtctaaagatcgtagagagaaggccgaaaccacactcgagaagtataaacaggagatcaagggcaggaaagacaagctgaactcgcagcttttgagcgcttttgatatggaccaacgccagctgccgtcccggctcctggacgaatggatgaatattagacctgcctcacatagtgtcaaattaaggacctacgttaagcagctgaacgaggattgtcgacttcgcttgcagaagttccggaaagacggggatggaaaggcaagagccatccccctcgtgggtgaaatggctacgtttctgtctcaagacatagtaaggatgattatcagcgaggaaactaaaaagctaatcacatccgcgtactataatgagatgcagcgttcactggcacagtacgccggcgaggaaaaccgccaccagttccgggctattgtggccgagctcagactgcttgatccaagctctgggcatcctttcttgtccgcaaccatggaaactgcccacaggtatacagaggacttctacaaatgctatctggaaaagaagcgagagtggttagctaaaaccttttaccggcccgagcaagatgaaaatacgaagcgcagaatcagtgtcttctttgtgccagacggagaggccaggaaactcctgccccttctgattcggcgaagaatgaaggaacagaacgatttgcaggactggatacgcaataaacaggcacaccctatcgatctcccaagccatctgttcgactctaaggttatggagctactgaaagtgaaggatggcaagaaaaagtggaacgaggcgtttaaagactggtggtccaccaagtatccggacggtatgcaacccttctacgggctcaggcgtgaactgaatattcacggcaaatcagtcagttacatccctagcgatggaaagaagtttgctgactgttatacacatcttatggagaaaactgtgcgggataagaaaagagaattgaggaccgccggcaagccagtaccccctgacctggcagcctacatcaaacgctcgttccaccgagctgttaacgagagagaatttatgttacggctcgtgcaggaggatgacaggctgatgcttatggccattaacaagataatgacagatcgcgaggaagacatcctgccagggctaaagaatattgattccatcctcgacaaagagaaccagttttctctggcagtccacgctaaggtgttggaaaaagagggagaaggtggcgataatagcctgtcattagtccccgccactattgagatcaagagtaaacgtaaggactggtccaagtatataagataccggtatgacaggcgcgtgccggggctcatgtctcatttccctgagcacaaagcgaccctggatgaagttaagacacttctgggagagtacgaccgatgcagaatcaaaatttttgattgggccttcgctttggaaggcgcaatcatgagcgaccgggatctcaagccatatctgcatgagtcctcaagcagggaaggtaaaagtggggagcactctaccctagtgaagatgctggtagagaaaaagggctgccttactcccgacgaatcccagtacctcattctgatccgcaacaaggccgctcataatcaatttccttgtgccgcagagatacccttgatttacagagatgtcagcgcgaaagtgggatcgatcgaaggctcatctgccaaggacctgccagaggggagttccttagttgatagcctctggaaaaagtatgagatgattatcaggaaaatactgcctatccttgaccccgaaaaccggttctttggaaagctgttgaataacatgtctcagccaattaatgatctctga

SEQ ID NO: 11314 - RNA, 3408 nt, synthetic construct
  misc_feature 1..3408: note = Cas13b variant__Porohyromonas gingivalis__WP_005873511.1__Cas13b
  source 1..3408: mol_type = other RNA
atgaacaccgtgcccgccagcgagaataagggccagtccagaacagtcgaagacgatcctcaatacttcgggctgtatctcaaccttgctagggagaatctgatcgaagttgagtctcacgtgcggattaaatttggaaagaaaaagttgaacgaagagtcattaaaacagagtctgctatgcgaccatctcctgagcgtagatcgctggactaaggtgtacggtcactcccgacgttatcttccattcctgcattactttgacccggattctcagatagagaaggaccacgattcgaaaacgggcgtcgaccccgattcagcacagagattgatcagggaactctatagcctgctggacttcctccggaatgattttagtcataaccgcttagacgggaccacattcgagcacctggaagtgtcccctgatatttctagctttatcactggaacctactcccttgcctgtggcagagcgcaatcaaggttcgctgactttttcaagccagacgattttgttttggccaaaaatcggaaggagcagctgattagtgtggcagacggtaaagagtgcctaacagtcagcgggctcgccttctttatctgtctgttccttgatcgcgaacaggcttctggaatgctgtcccgaataagaggcttcaagaggaccgacgagaactgggcacgggccgtgcacgaaactttttgcgatttgtgtatccgtcatccccacgaccgcctcgagtcaagcaatacaaaggaagctctgttactggatatgctcaacgagcttaatagatgccctaggattctgtatgacatgttgccagaggaggagcgggcccagttcctacccgcgctggatgaaaacagtatgaataacctctctgaaaattccctgaacgaagagagccgacttctgtgggacggctcgtctgattgggcagaggccttgaccaaacgcatcagacatcaagacaggtttccttacctcatgctgcggttcattgaagagatggacttactgaaggggatccgctttagagtagatctaggagaaatagagctcgactcctacagtaaaaaggttggtaggaacggcgaatatgatcgtacgattactgaccacgctctggccttcgggaaactttcagattttcagaatgaggaggaagtgagccggatgatctccggagaggcatcttacccagtccgattcagcttgtttgctccgagatatgccatttacgacaacaagatcggctattgtcacacctcagatcccgtgtaccctaaaagtaagacaggtgaaaagagggcgctgtccaatccacagagcatggggttcatctctgtgcataacctccgcaaactgcttctgatggagttgctctgcgagggatcatttagtcggatgcagagcgacttcctgagaaaggccaataggattttagatgaaactgcagagggcaaactgcaattttccgctctattccccgaaatgcgccaccgattcatacctccacagaaccccaagtctaaagaccggcgtgagaaggccgaaaccacactcgagaagtataaacaggagatcaagggcagaaaagataagctgaactcgcaacttttgagcgcttttgacatgaatcagaggcagctgccgtcccgcctcctggatgaatggatgaatattcggcctgcctcacatagtgtcaaattaagaacctacgttaagcagctgaacgaggactgtaggcttcgattgcgcaagttccggaaagacggggatggaaaggcaagagccatccccctcgtgggtgaaatggctacgtttctgtctcaagacatagtaaggatgattatcagcgaggaaactaaaaagctaatcacatccgcgtactataatgagatgcagcgttcactggcacagtacgccggcgaggaaaaccgccggcagttcagagctattgtggccgagctccatctgcttgatccaagctctgggcaccctttcttgtccgcaaccatggaaactgcccacaggtatacagaggacttctacaaatgctatctggaaaagaagcgagagtggttagctaaaaccttttaccggcccgagcaagatgaaaatacgaagcgcagaatcagtgtcttctttgtgccagacggagaggccaggaaactcctgccccttctgattcggcgaagaatgaaggaacagaacgatttgcaggactggatacgcaataaacaggcacaccctatcgatctcccaagccatctgttcgactctaagattatggagctactgaaagttaaggatggcaagaaaaagtggaacgaggcgtttaaagactggtggtccaccaagtatccggatggtatgcaacccttctacgggctcaggcgtgaactgaacatccacggcaaatcagtgagttacatccctagcgacggaaagaagtttgctgactgttatacacatcttatggagaaaactgtccaggataagaaacgggaattgagaaccgccggcaagccagtgccccctgacctggcagccgatattaaaaggtcgttccaccgcgctgtaaatgagcgagaatttatgttaagactcgttcaggaggacgatcggctgatgcttatggccataaacaagatgatgacagacagggaggaagatatcctgccagggctaaagaatattgactccatcctcgatgaggaaaaccagttttctctggcagtgcacgctaaagtcttggagaaggaaggagagggtggcgacaatagcctgtcattagtgcccgccactattgagatcaaaagtaagcgcaaagattggtccaagtacatacgttatagatacgaccggagggtcccggggctcatgtctcatttccctgaacacaaggcgaccctggacgaggtgaaaacacttctgggagaatatgatcgctgccgaatcaagatttttgactgggccttcgctttggagggcgcaatcatgagcgatagagacctcaaaccatacctgcatgaatcctcaagccgggagggtaagagtggggagcactctaccctagttaaaatgctggtggaaaagaaaggctgccttactcccgatgagtcccaatatctcattctgatcaggaacaaggccgctcataatcagtttccttgtgccgcagaaatgcccttgatataccgcgacgtaagcgcgaaggtcggatcgattgagggctcatctgccaaagatctgccagaggggagttccttagtggacagcctctggaagaaatacgaaatgatcattagaaagatcctgcctatacttgatcccgagaacaggttctttggaaaactgttgaataacatgtctcagccaatcaatgacctctga

SEQ ID NO: 11315 - RNA, 3408 nt, synthetic construct
  misc_feature 1..3408: note = Cas13b variant__Porohyromonas gulae__WP_039445055.1__Cas13b
  source 1..3408: mol_type = other RNA
atgaacaccgtgcccgccacagagaataagggccagagcagaactgtcgaagacgatcctcaatacttcgggctgtatctcaaccttgctagggagaatctgatcgaagttgagtcccacgtgcggattaaatttggaaagaaaaagttgaacgaagagtctttaaaacagtcactgctatgcgaccatctcctgagtatagatcgctggacgaaggtatacggtcacagccgacgttatcttccattcctgcattgttttgacccggattccggcatcgagaaggaccacgattctaaaaccggggtggaccccgattcggcacagagattgattagggaactctactcactgctggacttcctccggaatgattttagccataaccgcttagacggaacaactttcgagcacctgaaggtcagtcctgatatctcctcttttattaccggcgcctatacattcgcgtgcgaaagagctcagagcaggtttgccgacttctttaaaccagacgatttccttttggcaaagaatcggaaagagcaactgatctccgtggccgacggtaaggagtgtctaaccgtttcagggtttgctttcttcatatgcctctttctggatcgcgaacaggcaagtggaatgcttagccgaatcagaggcttcaagaggactgacgagaactgggcccgggctgtgcacgaaacattttgtgatctgtgcattcgtcatccccacgaccgcttggagtcttccaataccaaagaagccctcctgttagatatgctgaacgagctcaatagatgtcctaggatcctttacgacatgctgccagaggaagaacgggcgcagttcttgcccgcactagatgaaaactcaatgaataacctgagcgagaatagtctcaacgaagagtctcgactgctttgggacggctccagcgattgggccgaggctctgacgaagcgcattagacatcaggacaggtttccttatttgatgctccggttcatcgaagagatggacctgttaaaagggatacgctttagagtcgatctgggagaaattgagctagactcgtactctaagaaagtgggtaggaacggcgaatacgatcgtactatcaccgaccacgccctcgcattcgggaagctgtccgattttcaaaatgaggaggaagtatcacggatgattagtggagaggctagctatccagttcgattctccctttttgccccgagatacgcgatctatgacaacaaaatcggctactgccacacatctgatcccgtgtatcctaagagcaagactggtgaaaagagggccttgtcaaatccacagagtatggggttcatttccgtccatgacctgcgcaagctcctgcttatggagctgttgtgtgagggcagcttttctcggatgcagtcagatttcctcagaaaagcaaacaggatactggacgaaaccgctgagggaaagttacagttcagtgccctgtttcccgaaatgcgccaccgattcatccctccacaaaatcccaaaagcaaggatcggcgtgagaaggctgaaacaaccctagagaaatacaagcaggagattaaaggcagaaaggacaaactcaactcccagctgctttctgcctttgatatgaatcaaaggcagttgccgtcgcgcctgctcgacgaatggatgaacatccggcctgcaagccattccgtgaagctgagaacgtatgtgaagcagttaaatgaggactgcaggctgcgacttcgcaaattccggaaggatggggacggaaaagccagagctatacccttggtcggtgaaatggcgacttttctctcacaggatattgttaggatgatcatcagtgaggaaacaaagaaactgattacctctgcatactacaacgagatgcaacgtagcctagcccagtatgctggcgaggaaaatcgccggcagttcagagccatcgtggcagagctgcacctcctggacccatcctcagggcatccttttcttagcgccactatggaaacagctcacaggtacaccgaggatttctataagtgttacttggaaaagaaacgagagtggctggccaagacgttttatcggcccgagcaggacgaaaacaccaaacgcagaatttctgtattctttgtgccagatggagaggcaaggaagttactccccctgcttatacggcgaagaatgaaagaacaaaatgacctgcaggattggatccgcaacaagcaggcgcaccctattgacttgccatcccatctcttcgatagtaaaatcatggagctgctaaaggtcaaggacggcaaaaagaaatggaatgaggcttttaaggattggtggagcacaaaatacccggacggtatgcagcccttctatgggctgaggcgtgaactcaacatccacggcaagtctgtgtcctacattccttcagacggaaagaaattcgccgattgctacactcatctgatggagaagaccgttcgggacaaaaagagagaacttaggacagcaggcaaaccagtgccccctgatttggccgcttatataaagcgcagttttcaccgagccgtcaacgagagagagttcatgctgcggttagtgcaagaggacgataggctcatgctgatggcaatcaataagatgatgactgaccgcgaggaagatattcttccagggctgaaaaacatcgacagcattctagatgaggaaaatcagttttcgctcgctgtacacgccaaggttctggagaaagaaggagagggtggcgacaactccttgtctctggtgcccgcgaccatcgagataaagagcaaacgtaaggattggtcaaagtacatcagatatcggtacgacaggcgcgtcccggggttaatgagtcatttccctgaacacaaagccacactcgacgaggtgaagaccctgcttggagaatatgatcgatgcagaattaaaatctttgactgggctttcgcactggagggcgccattatgtccgatcgggacttgaagccatacctccatgaatctagctccagggagggtaaatcaggggagcacagcactctggtcaagatgctagtggagaaaaagggctgtctgacgcccgatgaaagtcagtatcttatcctcatacgcaataaggctgcccataaccagtttccttgcgcagcggaaatgcccctgatttacagagacgtttctgccaaagtgggatccatcgagggcagctcggctaaggatttgccagaggggtcatctctggtagacagtttatggaaaaagtacgaaatgattatcaggaaaatactccctatcctggatcacgagaatcggttctttggaaaacttctgaacaatatgtcccaacccattaacgacttgtga

SEQ ID NO: 11316 - RNA, 3528 nt, synthetic construct
  misc_feature 1..3528: note = Cas13b variant__Porphyromonas gingivalis__WP_052912312.1__Cas13b
  source 1..3528: mol_type = other RNA
atgaccgagcagaacgaaaagccctacaatggcacatattacactctggaggacaaacacttctgggccgcatttttcaacctcgctagacataatgcctatatcacgcttgcgcacattgataggcaactggcttacagcaaggccgacataaccaacgatgaagacatcttgtttttcaaagggcagtggaagaatttagataacgacctggagcggaaagcacgcctacgatccctcattctgaagcatttttctttccttgaaggagccgcttatggtaagaaactgtttgagtcacagagtagcggcaataagtcctctaaaaagaaagagttgacaaagaaggaaaaagaggaactccaggcaaacgccctgtcgctggataatctcaagtcaatcttattcgactttctgcaaaaacttaaggatttccgtaactactatagccactacagacatcctgagagttccgagttgccactgtttgacgggaatatgctacagaggctctacaacgtgttcgatgtctctgttcagcgggtgaaacgcgaccacgaacacaatgataaggtagacccgcatagacactttaaccatctggtgaggaaaggaaagaaggacaaatatggcaataacgataaccccttcttcaagcaccactttgtcgaccgggaggaaaaagtgactgaggctggtcttctgttctttgttagcttgttcctcgaaaagcgcgatgccatttggatgcagaaaaagatccgagggtttaagggaggcaccgaggcgtaccaacagatgacaaatgaggtgttctgcagatccaggatatcactgcctaaattaaagctggaaagtctccggaccgacgattggatgcttctggacatgttgaacgagctagtccgttgtccaaaactgctctatgatcgcctgagagaagaggacagggcacggtttcgagtgcccgtagatatccttagcgacgaagatgacactgacggcacagaggaggatcctttcaagaataccctggttcgccatcaggacagatttccatacttcgccttgaggtattttgatctcaaaaaggtgttcacgtctctgcggtttcacattgacttagggacttaccatttcgctatctataagaaaaacattggagaacagcccgaggatcgccacctgaccagaaatctatacggtttcggcaggatccaagactttgccgaggaacatcgtcctgaagagtggaagcggctcgtccgagatctggactacttcgagacaggggataaaccatatataactcagaccacaccgcactaccacattgaaaagggaaaaatcggccttagatttgtgcccgagggtcagttgctgtggccttccccagaagtgggggcaaccaggacgggacgctcaaagtatgctcaagacaagcggttcactgccgaggcgtttctcagcgtccatgagctgatgcccatgatgttctactattttcttctgagagaaaaatacagtgaggaagcctctgcagagaaggttcagggcaggattaaacgcgtgatcgaagatgtatatgctgtgtacgacgccttcgctcgagatgagatcaacacacgggacgagttggacgcctgcctcgcagataagggcattcgtagagggcatctgcctaggcagatgatagccatcttatcccaggaacacaaagacatggaggaaaaggtccgcaaaaagctgcaagagatgattgctgataccgaccaccggctagatatgctcgacagacagactgataggaagatccgaataggacgcaaaaatgcgggtctgccaaagagcggcgtgattgcagactggcttgttcgggatatgatgagatttcagcccgtggccaaagacacatcggggaagccgttgaacaattctaaagctaactccaccgaatacaggatgctgcagcgtgccctcgcactgttcggaggcgagaaggagcgcttaacgccttattttcggcaaatgaatctgaccggtgggaacaatccccacccattccttcatgaaacaagatgggagtcacacactaacatcttgagtttttacaggagctatctcaaggcccgaaaggctttcctgcagtccatcggccggtctgatcgcgaagagaatcatagattcctactgctcaaggaacctaaaaccgacaggcagacactggtcgccggatggaaaagcgagtttcaccttccccggggcattttcactgaggcagtgcgagattgtttgatcgaaatggggtacgacgaggtaggatcatataaagaagttggttttatggcgaaggctgtgccactgtacttcgagagagcctgcaaggaccgcgtccagcccttttatgattaccctttcaacgtgggcaacagtttaaaaccaaagaaagggaggtttctctccaaggagaaacgtgcagaagagtgggaaagcggaaaggagcggttcagagacctggaagcctggtctcattcagctgccaggcgcattgaggatgcatttgtcggcatagagtacgctagttgggaaaataagaaaaagatcgagcaacttctgcaggacttgagcctctgggaaaccttcgagtccaaactgaaggtgaaagccgataagattaacatcgcgaaactaaagaaggaaatcctggaggccaaagagcacccgtatcacgactttaagtcttggcagaaattcgaacgagagctcagactggttaagaatcaggatattataacatggatgatgtgtcgggaccttatggaagagaacaaagtggaaggtttggataccgggactctgtacttaaaggacatcaggacggatgtacaagagcagggctcgctcaatgtcctgaaccatgtgaagcccatgcgccttcctgttgtggtctatcgtgctgacagcagaggacacgtgcataaagaggaagcaccactggccacagtatacattgaggaacgggacaccaagctactcaaacagggcaatttcaagtcctttgtgaaagataggcgcctgaacgggttgttctcatttgttgacactggagctctggccatggagcaatatcccatcagtaagttacgagtcgagtacgaactcgcaaagtatcagaccgcgagagtgtgcgccttcgagcagacactggaacttgaggaatctctgttgacccggtaccctcacctcccagatgagagctttagggagatgctggaatcctggtcagaccccctactggataaatggccggaccttcagcgcgaggtgagactcctgattgctgtcaggaatgccttcagccataaccaataccctatgtatgatgaaactatcttttcttccatacggaagtacgacccaagtagcttggatgcaatcgaggaacgtatgggtctgaatattgctcaccgcttatctgaggaggttaaactcgccaaggaaatggtggagcgaatcattcaggcatga

SEQ ID NO: 11317 - RNA, 3360 nt, synthetic construct
  misc_feature 1..3360: note = Cas13b variant__Porphyromonas gingivalis__WP_053444417.1__Cas13b
  source 1..3360: mol_type = other RNA
atgaccgagcagaacgaaaagccctacaatggcacatattacactctggaggacaaacacttctgggccgcttttctcaaccttgcaagacataatgcctatatcacgctggcgcacattgataggcaattggcttacagcaaggccgacataaccaacgatgaagacatcttattctttaaagggcagtggaagaatctggataacgacctagagcggaaagcacgcctccgatccctgattcttaagcatttctcttttctggaaggagccgcttatggtaagaaattgttcgagtcacagagtagcggcaataagtcctctaaaaagaaagagctctcgaagaaggaaaaagaggaactgcaggcaaacgccctgtcactcgataatttaaagagcatcctgtttgacttccttcaaaaattgaaggattttcgtaactactatagtcactacagacatcctgagtcctctgagctgccactattcgacgggaatatgctccagaggctgtacaacgtgtttgatgtcagcgttcagcgggtgaaacgcgaccacgaacacaatgataaggtagacccgcatagacacttcaaccatcttgtgaggaaaggaaagaaggacaaatatggcaataacgataacccctttttcaagcaccacttcgtcgaccgggagggtacagtgactgaagctgggctgttgtttttcgtttccctctttctggagaaacgcgatgccatttggatgcagaagaaaatccgaggattcaagggcggcaccgaagcgtaccaacagatgacaaatgaggtgttttgcagatcaaggataagtttacctaagctgaaactcgagagccttcggaccgacgattggatgctgttggacatgctaaacgaactggtccgttgtccaaagtctctctatgatcgcctgagagaggaagacagggcacggttccgagtgcccgtagatatcctttccgacgaggatgacactgacgggacagaagaggatccttttaaaaataccctggttcgccatcaggacagattcccatactttgccttgaggtatttcgatctcaagaaagtgtttacgtcactgcggttccacattgacttaggaacttaccattttgctatctataagaagaacattggtgagcagcccgaagatcgccacctgaccagaaatctatacggcttcgggaggatccaagacttcgccgaggaacatcgtcctgaggaatggaaacggctcgtccgagatctggactactttgagacaggagataagccatatataactcagaccacaccgcactaccacattgagaaaggcaagatcggtcttagattcgtgcccgaagggcagcatttgtggcctagcccagaggtgggagcaaccaggacgggccgcagtaaatatgctcaagacaagcggctgactgccgaagcgtttctctctgtccacgagctgatgcccatgatgttctactattttcttctgagagagaagtactccgaagaggttagcgccgaaaaagtgcagggcaggattaagcgcgtaatcgaggatgtgtatgcagtctacgacgctttcgcccgagatgaaatcaacacacgggacgagttggacgcttgcctcgccgataaagggattcgtagaggacatctgcctaggcagatgatagcaatcttatcgcaggagcacaaggacatggaagagaaagtgcgcaagaaactgcaagaaatgattgccgataccgaccaccggctagatatgctcgacagacagactgataggaagatccgaataggtcgcaagaatgctggcctgccaaaatctggggttgtggcggactggcttgtccgggatatgatgagatttcagcccgtggcaaaggacacatccggaaaaccgttgaacaattcaaaggccaacagtaccgagtacaggatgctgcagcgtgctctcgccctgttcggcggtgaaaaagagcgcttaacgccttattttcggcaaatgaatctgaccgggggcaacaatccccatccattccttcacgagacaagatgggaaagccatactaacattttgtccttttacaggtcttatctcgaggcacgaaaggccttcctgcagagcatcggacggtcagatcgcgtagaaaatcacagatttctactgctcaaggagcctaaaaccgacaggcagacactggttgctggctggaagggggaatttcatcttccccggggaatcttcactgaggccgtgcgagattgtttgattgagatgggttacgacgaagtcggcagttataaagaggtggggtttatggcaaaggcggtcccactgtacttcgaaagagcttccaaagaccgcgtgcagcccttttatgattaccctttcaacgttggaaacagcttaaagccaaagaaaggcaggtttctctctaaggagaaacgtgccgaggaatgggagtcaggtaaggaacggttcagactggcaaaacttaagaaggagatcctggaagccaaagagcacccgtaccacgactttaagagttggcaaaaattcgagagggaattgcgcctcgtgaagaatcaggatattataacctggatgatgtgccgagacctgatggaggaaaacaaagtagaggggctagatacaggcaccctgtatctcaaggacatcagaactgatgtccaggaacagggaagcctgaatgtgcttaaccgggttaaacccatgaggttgcctgtggtcgtgtaccgcgctgactcccgtggccatgtacacaaggagcaagccccactggcaacggtgtatattgaggaaagagatacaaagttactcaaacaggggaattttaagtctttcgttaaagaccggaggctgaacggacttttctcgttcgtcgataccggtgctctggccatggagcagtaccccatcagcaagctacgcgtggaatatgagctcgcgaaataccaaactgcccgagtgtgtgctttcgaacagaccctggagttggaggaatccctgttaacaagatatcctcatctcccagacaagaattttcggaagatgctggagtcatggagtgacccccttctggataaatggccggacttgcacggcaacgtcaggctcctgatcgcagttcgcaatgccttctctcataaccagtaccctatgtacgatgaaaccctatttagctccattagaaagtatgacccatcaagccccgatgctatagaggagaggatggggctgaatatcgcccaccggctttctgaagaggtgaaacaggcaaaggaaatggtggagcgtattatccaagcgtga

SEQ ID NO: 11318 - RNA, 3360 nt, synthetic construct
  misc_feature 1..3360: note = Cas13b variant__Porphyromonas gingivalis__WP_012458414.1__Cas13b
  source 1..3360: mol_type = other RNA
atgaccgagcagaacgaaagaccctacaatggcacatattacactctggaggacaagcacttctgggccgcatttttcaacctcgctaggcataatgcctatatcacgcttgcgcacattgatcggcaactggcttacagcaaagccgacataaccaacgatgaagacatcttgtttttcaaggggcagtggaaaaatttagataacgacctggagcgcaaggcacgactacgttccctcattctgaaacatttttctttccttgaaggagccgcttatggtaagaagctgtttgagtcacagagtagcggcaataaatcctctaagaaaaaggagttgacaaagaaggaaaaggaggaactccaggcaaacgccctgtcgctggataatctcaaatcaatcttattcgactttctgcaaaaacttaaagatttcagaaactactatagccactacaggcatcctgagagttccgagttgccactgtttgacgggaatatgctacagcggctctacaacgtgttcgatgtctctgttcagcgcgtgaagagagaccacgaacacaatgataaagtagacccgcataggcactttaaccatctggtgcggaagggaaagaaggaccgctatggcaataacgataaccccttcttcaagcaccactttgtcgaccgagaggaaaaagtgactgaggctggtcttctgttctttgttagcttgttcctcgaaaagagagatgccatttggatgcagaaaaagatcagggggtttaaaggaggcaccgagacataccaacagatgaccaatgaggtgttctgccggtcccgtatatcactgcctaagttaaagctggaaagtctccgcactgacgattggatgcttctggacatgttgaacgagctagtcagatgtccaaaaagcctgtatgataggctccgggaagaggaccgagcgcgctttagagtgcccgtagatatcctgtctgacgaagatgacacagacggcaccgaggaggatcctttcaagaatacgcttgttaggcatcaggaccggtttccatacttcgcactgcgctattttgatttgaaaaaggtgttcacttccctcagatttcacattgacctggggacctaccatttcgccatctataaaaagaacattggagaacagcccgaggataggcacttaacacgtaatctgtacggtttcggccggatccaagactttgctgaagaacatcgacctgaagagtggaagaggctagtcagagatctcgactacttcgagactggggataaaccatatataacccagacaaccccgcactaccacattgaaaagggaaaaatcggcctgcgctttgtgcccgagggtcagcatctttggccttcaccagaagtgggggccacgcggactggaagaagcaagtatgcacaagacaaaaggttgacagctgaggccttcctgagtgtccacgagctcatgcccatgatgttttactatttcctgcttcgcgaaaagtactctgatgaggcgtccgccgaacgagttcagggccggattaagcgtgtgatcgaggacgtatatgcagtgtacgatgcttttgccagaggcgaaatcaacaccagggacgagctggacgcttgcttggccgataaagggattcgccggggacatctccctagacagatgataggtatcctgagccaggagcacaaggacatggaagagaaagtcaggaagaaattacaagaaatgattgtggatactgaccaccgactggatatgctagaccgccagacagatcggaagatcagaataggcaggaaaaatgcagggctcccaaagtcgggagttattgccgactggctggtgcgtgatatgatgcgcttccagcccgtcgctaaggacacctctggcaaaccgcttaacaattccaaggcgaactcaacggagtaccggatgttgcagagagcactggccctctttggtggggaaaaagagaggctgaccccttatttccgacaaatgaatttaacaggcggaaacaatccccatccatttctgcacgagactcggtgggaaagtcataccaacatccttagcttctaccgctcctatttgaaggctagaaaagcctttctccagtctatcggcaggagcgatcgggtggagaatcaccgattcctgctactgaaggaacctaagacagacagacagactctcgtagcagggtggaaaggagagttccatctgccccgcggtatttttaccgaagccgttagggattgtcttatcgagatgggcttggacgaggtggggtcatacaaggaagtcggattcatggctaaagccgtgccactgtattttgagcgtgcatgcaaggaccgggtccagcccttctacgattatccttttaacgtgggcaacagtttaaaaccaaagaagggtagattcctctccaaagaaaagagggcggaggagtgggaaagcgggaaagagcgctttcgactggctaaacttaaaaaggaaattctggaggccaaggaacacccgtacttggacttcaaatcttggcaaaagtttgagagagagctccggctggttaaaaatcaggatataatcacatggatgatttgtagggacctaatggaagagaacaaggtggaaggcctggataccggaactctctacctgaaagacatccgcacggatgtacaggagcagggcaatcttaacgtcttgaatcgtgtgaagcccatgagactgcctgttgtggtctatcgggcagactcaagggggcacgtgcataaagaacaagccccattagctacagtatacatcgaggagcgcgataccaagctcctgaagcagggaaacttcaaaagttttgtgaaggaccgaagacttaatggtctgttcagcttcgttgatactggcgccctagcaatggaacagtatcccatttccaaactccgggtcgagtacgaactggctaagtatcaaaccgccagggtgtgcgcgtttgagcagacattggaactggaggagtctttactcacccgctaccctcatctgccagacaaaaacttcagaaagatgcttgaatcgtggagcgaccccctgttggataagtggccggacctccacgggaatgtgaggctgctaatagccgtccggaacgctttttcccacaatcagtatcctatgtacgatgaggcagttttctcaagtatccgtaaatacgacccatctagccccgatgccattgaggagcgcatgggactgaacatcgctcatcgactttccgaggaagtgaagcaggccaaagagatggcagaaagaattatccaagcgtga

SEQ ID NO: 11319 - RNA, 3360 nt, synthetic construct
  misc_feature 1..3360: note = Cas13b variant__Porphyromonas gingivalis__WP_039417390.1__Cas13b
  source 1..3360: mol_type = other RNA
atgaccgagcagaacgaaagaccctacaatggcacatattacactctggaggacaagcacttctgggccgcatttttcaacctcgctaggcataatgcctatatcacgcttgcgcacattgatcggcaactggcttacagcaaagccgacataaccaacgatgaagacatcttgtttttcaaggggcagtggaaaaatttagataacgacctggagcgcaaggcacgactacgttccctcattctgaaacatttttctttccttgaaggagccgcttatggtaagaagctgtttgagtcacagagtagcggcaataaatcctctaagaaaaaggagttgacaaagaaggaaaaggaggaactccaggcaaacgccctgtcgctggataatctcaaatcaatcttattcgactttctgcaaaaacttaaagatttcagaaactactatagccactacaggcatcctgagagttccgagttgccactgtttgacgggaatatgctacagcggctctacaacgtgttcgatgtctctgttcagcgcgtgaagagagaccacgaacacaatgataaagtagacccgcataggcactttaaccatctggtgcggaagggaaagaaggaccgctatggcaataacgataaccccttcttcaagcaccactttgtcgaccgagagggtactgtgaccgaagctgggcttctgttctttgttagcttgttcctcgagaaaagagatgccatttggatgcagaagaaaatcaggggatttaagggcggcacagaagcgtaccaacagatgaccaatgaggtgttctgccggtcccgtatatcactgcctaaattaaagctggagagtctccgcactgacgattggatgcttctggacatgttgaacgagctagtcagatgtccaaagagcctgtatgataggctccgggaagaagaccgagcacgctttagagtgcccatcgatattctgtctgacgaggatgacacagacgggaccgaagaggatcctttcaaaaatacgcttgtaaggcatcaggaccggtttccatacttcgccctgcgctattttgatttgaagaaagttttcacttccctcagatttcacatcgacctgggaacctaccatttcgctatttataagaaaaacatcggtgagcagcccgaagataggcacttaacacgtaatctgtacggcttcgggcggatacaagactttgccgaggaacatcgacctgaggaatggaagaggctagtgagagatctcgactacttcgagactggagataagccatatattacccagacaaccccgcactaccacatcgagaaaggcaagattggtctgcgctttgtccccgaagggcagcatctttggccttcaccagaggtgggagcaacgcggactggcagaagcaaatatgctcaagacaagaggttgacagccgaagcgttcctgagtgtgcacgagctcatgcccatgatgttttactatttcctgcttcgcgagaaatactctgaagaggtctccgccgaaaaggttcagggccgaatcaagcgggtgatcgaggatgtatatgcagtgtacgacgcttttgcccgtggggaaattgataccctggacagattggacgcttgcctcgccgataaaggaataaggcgcggtcatctgcctcggcagatgatcgcaattttaagccaggagcacaaggacatggaggaaaaagtcagaaagaaactgcaagagatgatcgccgatactgaccacaggctagatatgctcgaccgacagacagatcgcaagatacggattggcaggaaaaacgctgggctgccaaagtcgggagtgatcgcggactggcttgttagagatatgatgcgtttccagcccgtggcaaaggacacctctggcaaaccgttgaataactccaaggccaattcaacggaataccgcatgctgcagcgggctctcgccctgtttggtggggagaaagaaagattaaccccttatttcaggcaaatgaacctgacaggcggaaataacccccatccatttcttcacgagactcgatgggagagtcataccaatatcttgagcttctaccggtcctatctcaaggcacgcaaagcctttctgcagtctattggcagaagcgatagggaagagaaccaccggttcctactgctcaaggaacctaagacagaccgacagactctggtcgctgggtggaaatcagagttccatcttcccagaggaatctttaccgaagccgtgcgcgattgtttgattgagatgggttacgacgaggtaggcagttataaggaagttgggttcatggcaaaagcggtgccactgtactttgagagggcttgcaaggaccgtgtccagcccttctatgattacccttttaatgtgggaaactccttaaaaccaaagaagggccggttcctcagcaaagaaaagagagccgaggagtgggaatctggtaaagagaggtttcgcctggcaaaacttaaaaaggaaatactggaggccaaggaacacccgtacttggacttcaaatcatggcaaaagtttgagcgagagctcagactggtcaaaaaccaggatatcattacatggatgatgtgtcgggacctaatggaagagaataaggtggaagggctggataccggcactctctatctgaaagacatcaggacggatgttcacgagcagggaagtcttaacgtgttgaatcgcgtaaagcccatgcgtctgcctgtcgtggtttacagagctgacagccggggccatgtgcacaaagaacaggccccattagcaacagtctatatcgaggagagggataccaagctcctgaagcaagggaacttcaaatcctttgtgaaggaccgccgacttaatggactgttctctttcgtagatactggtgctctagccatggaacagtaccccatttcgaaactcagagtggagtatgaactggcgaagtaccagaccgcccgggtttgcgcttttgagcaaacattggaactggaggagagcttactcaccaggtatcctcatctgccagacaaaaacttccgcaagatgcttgaatcctggtcagaccccctgttggataagtggccggacctccacagaaaagtcaggctgctaatagcagtgcggaatgcctttagtcataaccagtaccctatgtacgatgaggctgtgttctctagcatccgtaagtatgacccatcctcacccgatgccattgaggaacgcatgggcctgaatatcgcacaccgacttagcgaggaagtcaaacaggcgaaggagatggccgaaagaattatccaggtttga

SEQ ID NO: 11320 - RNA, 3528 nt, synthetic construct
  misc_feature 1..3528: note = Cas13b variant__Porphyromonas gingivalis__EOA10535.1__Cas13b
  source 1..3528: mol_type = other RNA
atgaccgagcagaacgaaaagccctacaatggcacatattacactctggaggacaaacacttctgggccgcatttttcaacctcgctagacataatgcctatatcacgcttacccacattgataggcaactggcgtacagcaaggctgacataacaaacgatgaagacatcttgtttttcaaagggcagtggaagaatttagataacgacctggagcggaaagcccgcctacgatccctcattctgaagcatttttctttccttgaaggagcagcctatggtaagaaactgtttgagtcacagagtagcggcaataagtcctctaaaaagaaagagttgactaagaaggaaaaagaggaactccaggctaacgcactgtcgctggataatctcaagtcaatcttattcgactttctgcaaaaacttaaggatttccgtaactactatagccactacagacatcctgagagttccgagttgccactgtttgacgggaatatgctacagaggctctacaacgtgttcgatgtctctgttcagcgggtgaaacgcgaccacgaacacaatgataaggtagacccgcatagacactttaaccatctggtgaggaaaggaaagaaggaccggtgcggcaataacgataaccccttcttcaaacaccactttgtcgaccgcgaggaaaaggtgaccgaggccggtcttctgttctttgttagcttgttcctcgaaaaacgagatgctatttggatgcagaagaaaatcagagggtttaagggaggcacagagacctatcaacagatgactaatgaggtgttctgtaggtcccggatatcactgcctaagttaaaactggaaagtctccgtacagacgattggatgcttctggacatgttgaacgagctagtccgctgcccaaagagcctgtacgatagactcagggaagaggaccgggcccgatttcgcgtgcccgtagatatcctgtctgacgaagatgacaccgacggcacggaggaggatcctttcaaaaatactcttgttagacatcaggacaggtttccatatttcgcgctgcggtactttgatttgaagaaagtgttcacctccctccgctttcacattgacctggggacatatcatttcgcaatctacaagaagaacattggagaacagcccgaggatagacacttaactaggaatctgtatggtttcggccgtatccaagactttgccgaagaacatcggcctgaagagtggaaacgactggtcagagatctcgactacttcgagaccggggataagccatacataacacagaccacgccgcactatcacattgaaaaaggaaagatcggcctgaggtttgtgcccgagggtcagcttttgtggccttcaccagaagtgggggctactcgcacaggacggagcaaatacgcccaagacaagagattcaccgcagaggcttttctgagtgtccatgagctcatgcccatgatgttctattactttctgcttagggaaaagtattctgaggaagcctccgcggagcgcgttcagggccgaattaaacgggtgatcgaagatgtatacgccgtgtatgacgcattcgctcgtggcgagatcgatactctggacagattggacgcctgtctcgctgataaggggattaggcgcggacacctacctcggcagatgatagccatcttaagccaggagcataaagacatggaagagaaggtcaggaaaaagctgcaagaaatgattgcagatacagaccacagactagatatgctcgaccgacagaccgatcgcaaaatccggataggtagaaagaacgccggcctgccaaagtcgggggtgattgctgactggcttgttagggatatgatgcgttttcagcccgtggcgaaagacacgtctggaaagccgttgaataactccaaagcaaattcaaccgagtaccgcatgctgcagcgggccctcgctctgttcggcggtgaaaaggagagattaacaccttactttaggcaaatgaacctgactgggggcaataacccccacccattccttcatgagacccgatgggaaagtcacacaaatatcttgagcttttatcggtcctacctcaaagcccgcaaggcattcctgcagtctatcggaagaagcgatagggtcgagaaccatcggttcctactgctcaaggaacctaaaactgaccgacagaccctggtggccggctggaagggggagtttcaccttcccagaggaattttcacagaagctgtacgcgattgcttgatcgagatgggtctggacgaggttggctcatataaagaagtggggtttatggccaaggcagtcccattatacttcgagagggcgtgtaaagaccgtgtgcagcccttttatgattaccctttcaatgtcggaaacagtctcaagccaaagaaaggccggtttctgtccaaggagaaaagagctgaggagtgggaaagcggtaaggagaggttccgcgaccttgaagcctggtctcattcagcagcccgaagaattgaggatgcttttgccgggatagaaaacgcaagtcgggagaataaaaagaagatcgagcaactgttgcaggacctcagcctgtgggaaaccttcgagtccaaactaaaggtgaaagctgataagattaacatcgccaaactgaagaaagaaatcctcgaggcgaaggaacacccgtatctggactttaagtcttggcagaaattcgagagggagcttcgcttggttaagaatcaggatattataacttggatgatgtgccgtgacctgatggaagagaacaaagtggaaggcttagatacgggaacactctacctgaaggacatcagaaccgatgtacacgagcaaggctcgcttaatgtcctgaaccgggtgaaacccatgaggctacctgttgtggtctaccgcgccgacagccgagggcatgtgcacaaggaacaggctccactcgcaactgtatatattgaggagagagacaccaagctgttgaaacagggaaatttcaagtcctttgtgaaagatcggaggctgaacggtttattctcatttgttgacacaggcgccctcgctatggaacaataccccatcagtaagctgcgcgtcgagtatgaacttgccaaataccagaccgcaagagtgtgtgcgttcgagcagactctggagttggaagagtctctcctgacaaggtatcctcatctaccagataagaattttcggaagatgctggaaagctggtccgacccccttctcgataaatggccggacctgcacgggaacgtgcgtttgctgattgccgtccgcaatgctttctcacataaccagtaccctatgtatgatgagacgttatttagctctatccgaaagtacgacccatccagtcccgatgccatagaagagagaatgggactcaatatcgcacacaggctgagcgaggaagttaaacaagctaaggagatggtggaacggattatccaggcctga

SEQ ID NO: 11321 - RNA, 3360 nt, synthetic construct
  misc_feature 1..3360: note = Cas13b variant__Porphyromonas gingivalis__WP_061156470.1__Cas13b
  source 1..3360: mol_type = other RNA
atgaccgagcagaacgaaagaccctacaatggcacatattacactctggaggacaagcacttctgggccgcatttttcaacctcgctaggcataatgcctatatcacgcttacccacattgatcggcaactggcgtacagcaaagctgacataacaaacgatgaagacatcttgtttttcaaggggcagtggaaaaatttagataacgacctggagcgcaaggcccgactacgttccctcattctgaaacatttttctttccttgaaggagcagcctatggtaagaagctgtttgagaataaatcaagtggcaacaagagctccaaaaagaaagagttgactaagaaggaaaaagaggaactccaggctaatgcactgtctctggataacctcaagtcgatcttattcgactttctgcagaaacttaaggatttcagaaattactattcacactacaggcatcctgagagcagtgagttgccactgtttgacgggaacatgctacaacggctctacaatgtgttcgatgtctccgttcagcgcgtgaaaagagaccacgaacacaacgataaggtagacccgcataggcactttaatcatctggtgcggaaaggaaagaaggaccgctgcggcaacaacgataatcccttcttcaaacaccactttgtcgaccgagagggtaaggtgaccgaagccgggcttctgttctttgtttctttgttcctcgagaaaagagatgctatttggatgcagaagaaaatcaggggatttaagggcggcacagaagcctatcagcaaatgaccaacgaggtgttctgtcggagccgtatatccctgcctaagttaaaactggagtcactccgcactgacgattggatgcttctggacatgttgaatgaactggtcagatgcccaaagagtctgtacgataggctccgggaggaagaccgagcgcgctttagagtgcccgtagatatcctgagcgacgaggatgacacagacgggaccgaagaggatcctttcaaaaacacgcttgttaggcatcaggaccggtttccatatttcgcactgcgctactttgatttgaagaaagtgttcacttctctcagatttcacattgacctgggaacctatcatttcgccatctacaagaagaatattggtgagcagcccgaagataggcacttaacacgtaacctgtatggcttcgggcggatccaggactttgctgaggaacatcgacctgaggaatggaaaaggctagtcagagatctcgactacttcgagactggagataagccatacataacccaaacaaccccgcactatcacattgagaaaggcaagatcggtctgcgctttgtgcccgaagggcagcatctttggccttccccagaggtgggagccacgcggactggcagatcaaaatacgcacaggacaagaggttgacagctgaagccttcctgagcgtccacgagctcatgcccatgatgttttattacttcctgcttcgcgagaagtatagtgaagaggtttctgcggaaaaagtgcaaggccgaattaagcgggtaatcgaggatgtgtacgccgtctatgacgcatttgctcgtggggaaatcgataccctggacagattggacgcctgtctcgctgataaaggaattaggcgcggtcatctgcctcggcagatgatagccatcttatcccaggagcacaaggacatggaggaaaaagtgagaaagaaactgcaggagatgattgcagatactgaccacaggctagatatgctcgaccgacaaacagatcgcaagatccggataggcagaaagaatgccgggctgccaaaaagcggagttattgctgactggcttgtgagggatatgatgcgtttccagcccgtcgcgaaggacacctcgggcaaaccgttgaacaattctaaggcaaactccacggaataccgcatgctgcagcgggccctcgctctgtttggtggggagaaagaaagattaaccccttacttcaggcagatgaatctgacaggcggaaacaatccccatccatttcttcacgagactcgatgggagtcacataccaacatcttgagtttctatcggagctacctcaaggcccgcaaggcatttctgcaatccatcggcagatctgatagggaagagaatcaccggttcctactgctcaaagaacctaagacagaccgacagactctggtggccgggtggaaaagcgagttccatcttcccagaggaatttttaccgaagctgtacgcgattgcttgatcgagatgggttatgacgaggttggctcatacaaggaagtggggttcatggccaaagcagtcccactgtattttgagagggcgtgtaaggaccgtgtgcagcccttctacgattatccttttaacgtcggaaacagtttaaagccgaaaaagggccggttcctctccaaagaaaagagagctgaggagtgggaaagcggtaaagagaggtttcgcctggccaaacttaagaaagaaattctggaggcaaaggaacacccatacttggacttcaaatcttggcagaagtttgagcgagagctcagactggtgaaaaatcaagatataatcacatggatgatgtgccgggacctaatggaagagaacaaggttgaagggctggataccggcactctctacctgaaagacattaggacggaggtgcaggaacagggatcacttaatgtattgaaccgcgtcaagcccatgcgtctgcctgtggttgtgtatagagccgatagtcggggccacgtccataaggagcaggctccattagccacagtgtacatcgaggaaagggacaccaaactcctgaagcaagggaatttcaagagctttgtaaaggatcgccgacttaacggactgttctccttcgtggacactggtggcctagcaatggagcagtatcccatctctaaactcagagttgaatacgagctggctaagtatcagaccgcccgggtctgtgcgtttgaacaaacattggagctggaggaatcgttactcaccaggtgccctcacctaccagataagaatttccgcaaaatgcttgagagctggtccgaccccctgttggacaagtggccggatctccagagagaagtgtggctgctaattgccgtgaggaacgctttttcacataatcagtaccctatgtatgacgaggcagtcttcagttctatacggaaatacgatccaagctcccccgacgccatcgaggaacgtatggggctgaacattgctcaccgcctttcagaggaagttaagcaggccaaagagatggcagaacgaatcattcaagcgtga

SEQ ID NO: 11322 - RNA, 3360 nt, synthetic construct
  misc_feature 1..3360: note = Cas13b variant__Porphyromonas gingivalis__WP_013816155.1__Cas13b
  source 1..3360: mol_type = other RNA
atgaccgagcagaacgaaaagccctacaatggcacatattacactctggaggacaaacacttctgggccgcatttttcaacctcgctagacataatgcctatatcacgcttgcgcacattgataggcaactggcttacagcaaggccgacataaccaacgatgaagacatcttgtttttcaaagggcagtggaagaatttagataacgacctggagcggaaagcacgcctacgatccctcattctgaagcatttttctttccttgaaggagccgcttatggtaagaaactgtttgagtcacagagtagcggcaataagtcctctaaaaacaaggagttgacaaagaaggaaaaggaggaactccaggcaaatgccctgtcgctggataacctcaaatcaatcttattcgactttctgcaaaaacttaaagatttccgtaattactatagccactacagacatcctgagagttccgagttgccactgtttgacgggaacatgctacagaggctctacaatgtgttcgatgtctctgttcagcgggtgaagcgcgaccacgaacacaacgataaagtagacccgcatagacactttaatcatctggtgaggaagggcaaaaaggaccggtatggaaacaacgataatcccttcttcaagcaccactttgtcgaccgcgagggtactgtgaccgaagctgggcttctgttctttgttagcttgttcctcgagaaacgagatgccatttggatgcagaagaaaatcagaggatttaagggcggcacagaaacctaccaacagatgactaacgaggtgttctgcaggtcccggatatcactgcctaaattaaagctggagagtctccgtacagacgattggatgcttctggacatgttgaatgagctagtccgctgtccaaagagcctgtatgatagactcagggaagaagaccgggcgcgatttcgcgtgcccgtagatatcctgtctgacgaggaagataccgacggggcagaggaggaccctttcaaaaacacgcttgttagacatcaggataggtttccatacttcgccctgcggtattttgacttgaagaaagtgttcacttccctccgctttcagattgatctgggaacctaccacttcgctatctataagaaaaatattggtgaacaacccgaggacagacatttaacaaggaacctgtacggcttcgggcgtatccaggattttgccgaggaacaccggcctgaagagtggaagcgactcgtcagagacctagattacttcgagactggagacaagccatatataacccagacaaccccgcattaccacattgaaaaaggcaagatcggtctgaggtttgtgcccgaggggcaacacctttggccttcaccagaagtgggagcaacgcgcactggccggagcaaatatgctcaggataagagattcacagccgaggcgtttttgagtgcccatgagctgatgcccatgatgttctactattttctcctgagggaaaaatactctgaggaagcatccgctgagcgcgtccagggccgaattaagcgggttatcgaagacgtgtatgccgtatacgatgctttcgcccgtgacgagatcaataccagagatgagcttgacgcatgcctggccgacaaggggattaggcgcggacacttgcctcggcagatgataggtatcctcagccaagaacataaagatatggaggaaaagattcgtaaaaagctgcaggagatgatggctgacactgatcacaggttagacatgctggatcgacagacagaccgcaaaatccggataggcagaaagaacgcggggctaccaaaatcgggagtgattgcagattggctcgtcagggacatgatgcgttttcagcccgtggccaaggatacctctggcaagccgctgaataactccaaagctaattcaacggaataccgcatgcttcaacgggccttggcactgttcggtggggagaaggagagactcaccccttattttaggcagatgaacctgacaggcggaaataacccccacccattcttacatgaaactcgatgggagagtcacaccaatatcctgagcttttaccggtcctatcttaaagcccgcaaggctttcttgcagtctatcggcagaagcgacagggttgaaaaccatcggttcctcctgctaaaagagcctaagacagatcgacagactctggtggccgggtggaagggagaatttcacctccccagaggtattttcaccgaggcagtccgcgactgtctgatcgagatgggccttgatgaagtggggtcatacaaagaggtaggatttatggcgaaggctgttccattgtatttcgaaagggcctgcaaagactgggtgcaacccttttacaactatcctttcaatgtcggcaacagtctgaagccgaaaaagggtagatttttatccaaggagaaacgggcagaggaatgggagagcgggaaggaaagattcaggctcgccaaactgaagaaagagattcttgaagctaaggagcatccatacctggactttaagtcttggcagaaattcgagcgcgaattgcgactcgtgaagaatcaggatataatcacatggatgatttgtggcgacctgatggaggaaaacaaagtcgagggactagataccggcactctgtacctcaaggacatcagaacggatgtgcaggaacaagggtcactgaatgttcttaaccgggtgaaacccatgaggttgcctgtagtcgtgtatcgcgccgacagtcgtggacacgttcacaaggagcaggcaccactggctacagtgtacatcgaggaaagagataccaaattactcaagcagggtaattttaagagcttcgtcaaagaccggaggctgaacggccttttctcctttgtggatactggggccctggcgatggagcaatatcccatttctaagctacgcgtagaatacgagctcgccaaatatcagaccgctcgagtgtgcgcattcgaacagacactggagttggaggaatcgctgttaaccagatgtcctcatctcccagacaagaattttcggaaaatgctggagagctggtccgatccccttctggacaagtggccggacttgcacaggaaggttcgcctcctgatagccgtcagaaacgctttctcacataatcagtaccctatgtatgatgaagccgtgtttagttctatcaggaaatacgaccccagcttcccagatgcaattgaggagcggatgggactaaacatcgcgcaccgtctgtccgaagaggtgaagcaagccaaagaaactgtcgagcgcattatccaggcttga

SEQ ID NO: 11323 - RNA, 3528 nt, synthetic construct
  misc_feature 1..3528: note = Cas13b variant__Porphyromonas gingivalis__WP_005874195.1__Cas13b
  source 1..3528: mol_type = other RNA
atgaccgagcagaacgaaaagccctacaatggcacatattacactctggaggacaaacacttctgggccgcatttttcaacctcgctagacataatgcctatatcacgcttgcgcacattgataggcaactggcttacagcaaggccgacataaccaacgatgaagacatcttgtttttcaaagggcagtggaagaatttagataacgacctggagcggaaagcacgcctacgatccctcattctgaagcatttttctttccttgaaggagccgcttatggtaagaaactgtttgagtcacagagtagcggcaataagtcctctaaaaagaaagagttgacaaagaaggaaaaagaggaactccaggcaaacgccctgtcgctggataatctcaagtcaatcttattcgactttctgcaaaaacttaaggatttccgtaactactatagccactacagacatcctgagagttccgagttgccactgtttgacgggaatatgctacagaggctctacaacgtgttcgatgtctctgttcagcgggtgaaacgcgaccacgaacacaatgataaggtagacccgcatagacactttaaccatctggtgaggaaaggaaagaaggacaaatatggcaataacgataaccccttcttcaagcaccactttgtcgaccgggaggaaaaagtgactgaggctggtcttctgttctttgttagcttgttcctcgaaaagcgcgatgccatttggatgcagaaaaagatccgagggtttaagggaggcaccgaggcgtaccaacagatgacaaatgaggtgttctgcagatccaggatatcactgcctaaattaaagctggaaagtctccggaccgacgattggatgcttctggacatgttgaacgagctagtccgttgtccaaaaagcctgtatgatcgcctcagagaagaggacagggcacggtttcgagtgcccgtagatatcctgtctgacgaagatgacactgacggcacagaggaggatcctttcaagaatacccttgttcgccatcaggacagatttccatacttcgccctgaggtattttgatttgaaaaaggtgttcacgtccctccggtttcacattgacctggggacttaccatttcgctatctataagaaaaacattggagaacagcccgaggatcgccacttaaccagaaatctgtacggtttcggcaggatccaagactttgccgaggaacatcgtcctgaagagtggaagcggctagtccgagatctcgactacttcgagacaggggataaaccatatataactcagaccacaccgcactaccacattgaaaagggaaaaatcggcctgagatttgtgcccgagggtcagcttttgtggccttcaccagaagtgggggcaaccaggacgggacgcagcaagtatgctcaagacaagcggttcactgccgaggcgtttctgagtgtccatgagctcatgcccatgatgttctactattttctgcttagagaaaaatactctgaggaagcctccgcagagaaggttcagggcaggattaaacgcgtgatcgaagatgtatatgctgtgtacgacgccttcgctcgagatgagatcaacacacgggacgagctggacgcctgcttggcagataagggcattcgtagagggcacctccctaggcagatgatagccatcctgagccaggaacataaagacatggaggaaaaggtccgcaaaaagttacaagagatgattgctgataccgaccaccggctggatatgctagacagacagactgataggaagatccgaataggacgcaaaaatgcgggtctcccaaagtcgggcgtgattgcagactggctggttcgggatatgatgagatttcagcccgtggccaaagacacatctgggaagccgcttaacaattccaaagctaactcaaccgaatacaggatgttgcagcgtgccctggcactcttcggaggcgagaaggagcgcctgacgccttattttcggcaaatgaatttaaccggtgggaacaatccccacccattcctgcatgaaacaagatgggagagtcacactaacatccttagcttttacaggtcctatttgaaggcccgaaaggctttcctccagtctatcggccggagcgatcgcgaagagaatcatagattcctgctactgaaagaacctaaaaccgacaggcagacactcgtcgccggatggaagtcagagtttcatctgccccggggcattttcactgaggcagtgcgagattgtcttatcgaaatggggtacgacgaggtaggaagttataaagaagttggttttatggcgaaggctgtgccattgtacttcgagagagcctgcaaggaccgcgtccagcccttttatgattaccctttcaacgtgggcaactccctgaaaccaaagaaagggaggtttttaagcaaggagaaacgtgcagaagagtgggaatctggaaaggagcggttcagagacctcgaagcctggtcacacagtgctgccaggcgcattgaggatgcatttgtcggcatagagtacgctagctgggaaaataagaaaaagatcgagcaactgcttcaggacctgtccttgtgggaaaccttcgagtctaaactcaaggtgaaagccgataagattaacatcgcgaaactgaagaaggaaatcctagaggccaaagagcacccgtatcacgactttaagtcgtggcagaaattcgaacgagagctgagactcgttaagaatcaggatattataacatggatgatgtgtcgggacctgatggaagagaacaaagtggaaggtcttgataccgggactttgtacctgaaggacatcaggacggatgtacaagagcagggcagcttaaatgtcctcaaccatgtgaagcccatgcgcctgcctgttgtggtctatcgtgctgactccagaggacacgtgcataaagaggaagcaccacttgccacagtatacattgaggaacgggacaccaagctgctaaaacagggcaatttcaagtcatttgtgaaagataggcgcctcaacgggctgttcagttttgttgacactggagctttggccatggagcaatatcccatctctaagctgcgagtcgagtacgaattagcaaagtatcagaccgcgagagtgtgcgccttcgagcagacactcgaactggaggaaagccttctgacccggtaccctcacttgccagatgagtcctttagggagatgctcgaatcatggagcgaccccctgctagataaatggccggacctgcagcgcgaggtgagacttctcattgctgtcaggaatgccttctctcataaccaataccctatgtatgatgaaactatcttttccagtatacggaagtacgacccaagctctctggatgcaatcgaggaacgtatgggtttgaatattgctcaccgcctgtccgaggaggttaaattagccaaggaaatggtggagcgaatcattcaggcatga

SEQ ID NO: 11324 - RNA, 3360 nt, synthetic construct
  misc_feature 1..3360: note = Cas13b variant__Porphyromonas gulae__WP_039437199.1__Cas13b
  source 1..3360: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatgaagacatcttattctttaaggggcagtggaaaaacctggataatgacctagagcgcaagtctcgactccgttcactgattcttaaacatttcagttttctggaaggagccgcatatggtaagaagttctttgagagcaaatcctctggcaacaagtcgtcaaagaataaggagttgactaaaaaggaaaaggaggaactccaggccaacgctctgagcctggataatctcaaaagtatcttattcgactttctgcagaaacttaaagatttcagaaactactattcccactacaggcattctgggagctccgagttgcctctgtttgacggaaatatgctacaacggctctacaacgtgttcgatgtctcagttcagcgcgtgaagagagaccacgagcacaatgatgaagtagacccacattatcactttaaccatctggtgaggaaaggcaagaaagaccggtacggtcacaatgataacccgagtttcaagcaccatttcgtcgacggggagggaatggtgaccgaagcaggccttctgtttttcgttagcttgtttctcgagaagcgcgatgccatttggatgcagaaaaagatccgaggcttcaaagggggaacagaaccctatgagcagatgaccaacgaggtgttttgcagatctaggatatccctgcctaagttaaaactggaatcactccggactgacgattggatgcttctggacatgttgaatgagctagtccgttgtccaaagcccctgtacgatcgcctcagagaaaaggacagggcttgcttccgggtgcctgtagatatcctgccagacgaggatgacacagacggtggcggggaagatccctttaaaaacacccttgttcgacaccaagaccgcttcccttattttgccctgagatacttcgatttgaagaaagtgtttacgagcctcaggttccatattgacctgggaacttatcactttgcgatctacaagaaaatgattggcgagcagccagaggatcggcatttaacccgcaatctgtacggtttcgggagaatccaggacttcgcagaggaacacaggccggaagagtggaagcgtctagtccgggatctcgactattttgaaacaggagataagccctacataagtcagactacccctcactatcatattgagaaaggcaagatcggcctgcgattcgtgccagaggggcaacacctttggccctctcctgaagtgggaacaaccagaacgggtaggtccaaatacgcccaggacaagcgcttgactgctgaggcctttctgagcgtccatgaactcatgccaatgatgttctattactttctgcttcgggagaaatattcggaggaagtttctgcagagaaggtgcagggcagaattaagagggtaatcgaagatgtgtacgctatctacgacgccttcgcgcgcgatgagattaacacactgaaagaattggacgcctgtctcgcagacaaggggatacgacggggacatctgcccaaacaaatgatcggcattttatcccaggagcgtaaggatatggaggaaaaagtcagaaagaaactgcaggagatgatcgctgacaccgatcacaggctagacatgctcgatcgccagactgaccggaagataagaattggtaggaagaatgccgggctgccgaaatcaggcgtgatcgctgattggcttgttcgagacatgatgcgctttcaacctgtggccaaggatacaagtggaaaacccttgaacaatagcaaggcaaactccaccgaatatcggatgctgcagagagccctcgctctgttcggcggggagaaagaaaggttaacgccatactttcgtcagatgaatctgaccggaggtaacaatcctcaccccttccttcacgagacacgctgggagtctcatactaacatcttgagcttttatcggtcatacctcagagcgaggaaggcattcctggaacgaattggccggagtgaccgcgtcgagaattgcccatttctactgctcaaggaacccaaaaccgatagacagacactggtggccgggtggaagggagagttccaccttcctaggggcatcttcactgaagctgtacgggactgtttgattgagatgggttatgatgaggttgggtcctaccgagaagtgggctttatggccaaagcagtcccactgtatttcgagagagcctgcgaagaccgcgtgcaaccgttttacgacagccccttcaacgtcggaaattctttaaagcctaaaaagggcaggtttctctcaaaggagaaacgtgctgaggaatgggagagtgggaaggaacggttcagactggccaaacttaagaaagagatactggaagcacaggagcatccataccacgattttaagagctggcagaagttcgagagggaattgcgcctcgtgaaaaaccaggacatcattacctggatgatgtgtcgagatctgatggaggaaaacaaggttgagggactagacacaggtaccctgtatctcaaagatatcagacccaatgtgcaagaacagggctccctgaacgtacttaatcgggtcaagcctatgaggttgccagtggttgtgtaccgcgcggactctcgtgggcacgtccataaagaggaggctcccctggccactgtgtatatcgaagagagagatacgaagttactcaaacagggaaactttaagtcgttcgtaaaggaccggaggctgaatggcctttttagcttcgtggatacaggtgcactggccatggaacagtacccgatttccaaactacgcgttgagtatgaactcgctaagtaccaaaccgcccgagtctgcgcattcgagcagactctggagttggaagagtcactgttaaccagatatcctcacctcccagacgaaagttttcgggagatgctggagtcttggagcgatccccttctgacaaaatggcctgaattgcatgggaaggtgaggctcctgatagctgtgcgcaacgccttctcccacaatcagtaccccatgtacgacgaggcggtcttttcaagcatctggaaatatgacccatcttcccctgatgccattgaagagagaatgggcctaaacatcgctcataggctgagtgaagaggttaagcaagcaaaggagaccattgaacggatcatacaggcctga

SEQ ID NO: 11325 - RNA, 3360 nt, synthetic construct
  misc_feature 1..3360: note = Cas13b variant__Porphyromonas gulae__WP_039419792.1__Cas13b
  source 1..3360: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaacctagataatgacctcgaacgcaagtcacgactgcgtagtcttatcctgaaacattttagcttcttggagggggcagcctatggaaagaagctctttgaatccaaatcttcgggtaacaagtcaagcaaaaataaggagctgactaaaaaggagaaggaagaactgcaggctaacgcactcagtttagataatctgaaatccattcttttcgactttttgcagaagctgaaagatttcagaaactactattctcactacaggcatagcggctcctcagaactacctctctttgacgggaatatgctgcaacggctttacaacgtcttcgatgttagtgtgcagcgcgtaaagagagaccacgagcacaatgataaagtggacccacataggcactttaaccatctggtccggaagggaaagaaggaccgctatggccacaatgataacccgagcttcaagcaccattttgtggacggtgaggggatggttaccgaagccggacttctcttcttcgtgtctctgtttttagagaaacgagatgctatctggatgcagaagaaaattagaggcttcaagggcgggacagaaacctaccagcaaatgactaacgaggtcttttgcaggtcccggatctcactgcccaaactcaagttggaaagcctgcgtacagacgattggatgttgctagacatgctgaatgagctcgtgcgctgtcctaagccactgtatgatagacttagggagaaagaccgggcccgattccgcgtacccgttgatatactgcctgacgaagatgacaccgacggaggtggcgaggatccatttaagaacacgttggtgagacaccaggacaggttcccctactttgcgctccggtatttcgatctgaaaaaggtctttaccagtttacgcttccatatcgacctggggacttaccactttgcaatttataaaaaggtgatcggagaacagcctgaggatagacatctaacaaggaatctctacggcttcggtcgtattcaggactttgccgaagaacaccggccagaggaatggaagcgactggtgagagatcttgactacttcgagactggggataaaccgtatatctctcaaaccacaccccactaccatatagaaaagggaaaaattggcttgaggttcgtccctgagggccagcacctgtggccatcccccgaagttgggaccacgcgcactggacggagcaagtatgctcaggacaaaagactcacagccgaggcatttctgtcggtgcatgagcttatgcctatgatgttctactattttctgttgagggaaaagtactctgaggaagtatccgctgagaaggtgcaaggtcgcatcaaacgagtcattgaggatgtgtatgccatctacgacgcgttcgcccgggatgaaatcaacacccgtgacgagctcgacgcatgcctggctgataagggcattagaagggggcacttaccaaaacagatgataggaatcctgtcacaggaacacaagaatatggaggaaaaagttcgcaagaaactacaggagatgattgccgacactgatcatcggctcgacatgctggatagacaaacagacaggaagatccgaataggccgcaagaacgctggtcttcccaaaagtggggtgattgccgattggttggtccgggacatgatgagatttcagccggtggcaaaggataccagcggcaaacctctgaataactccaaggccaattctacggagtacaggatgctccagcgtgctctggcgttattcggaggcgaaaaagagcgcctgaccccctattttcggcagatgaaccttacagggggaaataacccacaccctttcttggacgaaactagatgggagagccataccaatatcctctcattttacaggagttatctgcgagcacggaaggccttcctagaacgcatcggtagatccgatagggtagagaaccggccctttctgctcctgaaggagccaaaaacagaccgacaaactcttgttgctggctggaaaagcgagttccacttgcccagagggatttttaccgaggccgtgcgcgattgtctgatcgaaatgggatacgacgaggtcggctcttataaagaagtgggtttcatggcaaaggccgtccctttatacttcgagagggcttgcaaagaccgtgtgcagccattttatgattcaccgttcaatgttgggaacagtctcaagcccaagaaaggccggtttctgagcaaggagaaaagagccgaagagtgggaatccggaaaggagaggttccgccttgcaaaactgaagaaggagattttggaagcgcaggagcatccttaccacgactttaaatcttggcagaagttcgaacgagagctcagactggtgaaaaaccaagatataatcacatggatgatgtgtcgggacctaatggaagagaataaggtagagggcctggataccgggactctctacctgaaagacattaggccaaacgtccaggaacagggatcgcttaatgtgttgaaccgcgttaagcccatgcgtctgcctgtggtcgtgtatagagctgatagccggggtcacgtacataaagaggaagccccattagcaacggtgtacatcgaggaaagggacacaaagctcctgaagcagggcaattttaaatccttcgttaaggatcgccgacttaacgggctgttttcattcgtcgacaccggaggcctagccatggagcaatatcccatcagtaaactcagagtggagtacgaactggctaagtatcagactgcccgggtgtgcgtctttgagttgaccctgaggttagaagagtctctcctgagccgctacccgcaccttcctgatgaatccttcagagagatgctggagtcatggagcgacccattgctcgcaaaatggcccgaactgcatggtaaggttaggctactgattgctgtgcggaatgccttctctcacaaccagtatcctatgtacgacgaggcggtgttttccagtatacgtaagtacgatcccagctctccagacgccatcgaggagcgcatggggcttaatattgctcatcgactctccgaggaagtaaaacaagcaaaggagacagtcgaaagaatcattcaggcctga

SEQ ID NO: 11326 - RNA, 3528 nt, synthetic construct
  misc_feature 1..3528: note = Cas13b variant__Porphyromonas gulae__WP_039431778.1__Cas13b
  source 1..3528: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaactttgataatgacctagaacgcaagtcacgactccgtagtctgatccttaaacatttcagctttctggagggggcagcctatggaaagaagttgttcgaatccaaatcttcgggtaacaagtcaagcaaaaataaggagctcactaaaaaggagaaggaagaactgcaggctaacgcactgagtctcgataatttaaaatccattctgtttgacttccttcagaagttgaaagattttagaaactactattctcactacaggcatagcgaatcctcagagctgcctctattcgacggcaatatgctccaacggctgtacaacgtctttgatgttagtgtgcagcgcgtaaagagagaccacgagcacaatgataaagtggacccacataggcacttcaaccatcttgtccggaaggggaaaaaggaccgctatggacacaatgataacccgagctttaagcaccatttcgtggacggcgaaggtatggttaccgaggccgggctgttgttctttgtgtctctcttcctggaaaaacgagatgctatctggatgcagaagaaaattagaggatttaagggcggcacagagacctaccagcaaatgactaacgaagtcttctgcaggtcccggatctcattacccaaactgaagctcgagagccttcgtacagacgattggatgctgttggacatgctaaatgagctggtgcgctgtcctaagccactctatgatagactgagggaagacgatcgggcctgctttcgagtacccgttgacatacttcctgatgaggacgacaccgatgggggaggtgaagacccattcaaaaacacgctggtgcgccaccaggatagatttccctacttcgcgttgaggtattttgacctcaagaaagtcttcacttccctgcggtttcatatcgatttaggcacctaccacttcgcaatttataagaaaatgatcggggagcagcctgaagaccgccatctgacaagaaatctatacggatttggcaggattcaggatttcgccgaggagcaccgtccagaagagtggaagcggctcgtgcgagacctggattacttcgaaactggtgacaagccgtatatctctcaaaccagtccccactaccatatagagaaagggaagattggacttagatttatgcctgaaggccagcacttgtggccaagccccgaggtgggcacaaccaggacggggcgctcgaaatatgctcaggataagcggctgactgccgaggcattcctctctgtccatgaactgatgcctatgatgttttactatttccttctgagagagaaatactccgaagaggtttcagctgagaaggtgcaaggaaggatcaagcgcgtaattgaagacgtgtatgccatctacgatgcgtttgcccgagacgagatcaacacattgaaagaactcgacgcatgtctggctgataagggtattcggcgtggccacttaccaaaacagatgatagccatcctgagtcaggagcacaaggacatggaagagaaaattagaaagaaactacaggagatgatcgctgataccgaccataggctcgatatgctggaccgccaaactgatcggaagataagaattgggaggaagaatgccggacttcccaaaagcggcgtcatcgcagactggttggtgcgagatatgatgcgcttccagccggttgccaaggacacatccggtaaacctctgaacaattctaaggctaacagcaccgaataccggatgctccagagagcgctggcattatttgggggcgagaaaaagaggctgacgccctatttccgtcagatgaatcttaccggaggcaacaatccacacccctttttgcatgaaacacgctgggagtcacacactaacatcctcagtttctaccggtcctatctgagagccaggaaggcttttctagaacgaattgggcggagcgatcgcatggagaatagacccttcctgctcctgaaagagccaaagaccgacaggcaaacacttgtggccggatggaaatctgaatttcatttgccccggggtatcttcactgaggcagtccgagattgcctgattgaaatgggctacgacgaggtggggtcatatagagaagtaggattcatggccaaggctgttcctttatactttgagcgcgcctgtgaggacagggtgcagccattctatgatagtccgtttaacgtcggcaatagcctcaaacccaagaagggtcgtttcctgtccaaagaagaacgggcagaagagtgggagagagggaaggaaaggtttcgcgaccttgaggcgtggtctcactcggctgcccgaagaatagaagatgcattcgccggcatcgagtacgctagccctggaaacaaaaagaaaattgaacagctgttgcgggacctctccctgtgggaggcctttgagtcaaagctaaaggtgagggcagataaaatcaacctggctaagctcaaaaaggaaatcctggaggcccaggaacacccataccatgacttcaaaagttggcaaaagtttgagcgcgaacttcgtttggtcaaaaatcaggatattataacctggatgatgtgcagagacctgatggaggagaacaaggtggaaggcttagatacagggaccctctatctgaaggacatccggcccaatgttcaggagcagggatctcttaacgtgctgaatagggtaaaacctatgcgcctaccagtcgtggtttaccgagcggatagcagaggtcacgtgcataaggaagaggcccctctcgctactgtctatattgaggagcgggacacgaaactgttgaagcaaggcaacttcaaatcctttgtgaaggacaggcgcctgaatgggttattctcattcgtagatacaggaggcctcgcaatggagcagtacccgatcagcaagctgagagtggaatatgagcttgccaaataccagaccgctagggtttgtgtctttgaactgactttgcggctcgaggagtctctgctaacccgttatcctcatctgccagacgaatccttccgcaagatgcttgagagttggagcgatcccctcctggccaaatggcctgaattgcacggtaaggtgcgactgttaattgcagtgagaaacgcgttttctcacaatcaataccccatgtacgacgaggccgtcttctcctcaatcaggaaatatgatccaagtagccctgacgctatagaggagcggatggggctcaacatcgcccaccgcctgtcggaggaagttaagcaggcaaaggagacagtggaaagaattatccaggtgtga

SEQ ID NO: 11327 - RNA, 3528 nt, synthetic construct
  misc_feature 1..3528: note = Cas13b variant__Porphyromonas gulae__WP_046201018.1__Cas13b
  source 1..3528: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaactttgataatgacctagaacgcaagtcacgactccgtagtctgatccttaaacatttcagctttctggagggggcagcctatggaaagaagttgttcgaatccaaatcttcgggtaacaagtcaagcaaaaataaggagctcactaaaaaggagaaggaagaactgcaggctaacgcactgagtctcgataatttaaaatccattctgtttgacttccttcagaagttgaaagattttagaaactactattctcactacaggcatagcgaatcctcagagctgcctctattcgacggcaatatgctccaacggctgtacaacgtctttgatgttagtgtgcagcgcgtaaagagagaccacgagcacaatgataaagtggacccacataggcacttcaaccatcttgtccggaaggggaaaaaggaccgctatggacacaatgataacccgagctttaagcaccatttcgtggactctgaaggcatggttaccgaggccggtctgttgttctttgtgtccctcttcctggaaaaacgagatgctatctggatgcagaagaaaattagagggtttaagggaggcacagagacctaccagcaaatgactaacgaagtcttctgcaggtcacggatcagcttacccaaactgaagctcgagagtcttcgtacagacgattggatgctgttggacatgctaaatgagctggtgcgctgtcctaagccactctatgatagactgagggaaaaagaccgggcccgatttcgcgtacccgttgatatacttcctgacgaggatgacaccgacggcgggggagaagatccattcaagaacacgctggtgagacaccaggacaggtttccctacttcgcgttgcggtattttgatctcaaaaaggtcttcacttctctgcgctttcatatcgacttaggtacctaccacttcgcaatttataaaaagatgatcggcgagcagcctgaagatagacatctgacaaggaatctatacgggtttggacgtattcaggacttcgccgaggagcaccggccagaagagtggaagcgactcgtgagagatctggactacttcgaaactggcgataaaccgtatatctcccaaaccacaccccactaccatatagagaagggtaaaattgggcttaggtttatgcctgaaggacagcacttgtggccaagccccgaggtgggcaccacgcgcactggccggtcgaagtatgctcaggacaaaagactgacagccgaggcattcctctctgtccatgaactgatgcctatgatgttttactatttccttctgagggagaagtactccgaagaggtttcagctgagaaggtgcaagggcgcatcaaacgagtaattgaagatgtgtatgccatctacgacgcgtttgcccgggatgagatcaacaccttgaaggaactcgacgcatgcctggctgacaaaggtattcgtagaggacacttaccaaagcagatgatagccatcctgagtcaggagcacaaagatatggaagagaagattaggaaaaagctacaggagatgatcgctgacactgatcatcgcctcgacatgctggatcggcaaacagacagaaagataaggattggccgcaaaaatgccgggcttcccaagagcggagtcatcgcagattggttggtgcgagacatgatgcggttccagccggttgccaaagatacctccggcaagcctctgaacaattctaaagctaacagcacggaatacagaatgctccagagggcgctggcattatttggtggggagaagaagcgtctgaccccctatttccgccagatgaatcttacaggcggaaacaatccacacccctttttgcatgaaactcggtgggagtcacacaccaacatcctcagtttctacagatcctatctgagggcccgaaaggcttttctagaacggattggccgcagcgacagaatggagaataggcccttcctgctcctgaaagagccaaaaacagatcggcaaactcttgtggccgggtggaagtctgaatttcatttgccccgaggaatcttcaccgaggcagtcagagactgtctgattgaaatgggttacgatgaggtgggctcatatcgcgaagtagggttcatggccaaagctgttcctttatactttgagagggcctgcgaggaccgtgtgcagccattctatgacagtccgtttaacgtcggaaatagcctcaagcccaagaaaggccggttcctgtccaaggaagagagagcagaagagtgggagaggggtaaagaacgctttcgagatcttgaggcgtggtctcactcggctgccagacggatagaagacgcattcgccgggatcgagtacgctagccctggcaacaagaaaaagattgaacagctgttgagggatctctccctgtgggaggcctttgagtcaaagctaaaagtgcgcgcagacaagatcaacctggctaaactcaagaaagaaatcctggaggcccaggaacacccataccatgatttcaagagttggcaaaaatttgagcgtgaacttagattggtcaagaatcaggacattataacatggatgatgtgtcgggatctgatggaggagaacaaggtggaaggattagacaccggcactctctatctgaaagatatcaggcccaatgttcaggagcaggggtctcttaacgtgctgaatcgcgtaaagcctatgcgactaccagtcgtggtttacagagcggacagccggggacacgtgcataaagaagaggcccctctcgctacggtctatattgaagagagggatacaaagctgttgaaacaaggtaacttcaagtcctttgtgaaggaccgcagactgaatggcttattctcattcgtagacaccgggggactcgcaatggagcagtacccgatcagcaaactgagggtggaatatgagcttgccaagtaccagactgctcgggtttgcgtctttgaactgaccttgcgtctcgaggagtctctgctaacacgctatcctcatctgccagatgaatccttccgaaaaatgcttgagagttggagcgaccccctcctggccaagtggcctgaattgcacggcaaagtgagactgttaattgcagtgaggaacgcgttttctcacaatcaataccccatgtacgatgaggccgtcttctcctcaatccggaagtatgacccaagtagccctgatgctatagaggagcgcatgggtctcaacatcgcccacagactgtcggaggaagttaagcaggcaaaagagaccgtggaaaggattatccaggtgtga

SEQ ID NO: 11328 - RNA, 3525 nt, synthetic construct
  misc_feature 1..3525: note = Cas13b variant__Porphyromonas gulae__WP_039442171.1__Cas13b
  source 1..3525: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaacctagataatgacctcgaacgcaagtcacgactgcgtagtcttatcctgaaacattttagcttcttggagggggcagcctatggaaagaagctctttgaatccaaatcttcgggtaacaagtcaagcaaaaataaggagctgactaaaaaggagaaggaagaactgcaggctaacgcactcagtttagataatctgaaatccattcttttcgactttttgcagaagctgaaagatttcagaaactactattctcactacaggcatagcggctcctcagaactacctctctttgacgggaatatgctgcaacggctttacaacgtcttcgatgttagtgtgcagcgcgtaaagagagaccacgagcacaatgataaagtggacccacattatcactttaaccatctggtcaggaagggaaagaaggaccggtacggccacaatgataacccgagcttcaagcaccattttgtggactctgagggtatggttaccgaagccgggctcttgttcttcgtgtccctgtttttagagaaacgcgatgctatctggatgcagaagaaaattcgaggattcaagggcggcacagggccctatgaacagatgaccaacgaggtcttttgcagatcaaggatcagcctgcctaaactcaaacttgaaagtctgcggactgacgattggatgttgctagacatgctgaatgagctcgtgcgttgtccaaagcccctgtacgatcgccttagagagaaagacagggcctgcttccgggtacctgttgatatactgccagacgaagatgacacagacggaggtggcgaggatccctttaagaacaccttggtgcgacaccaagaccgcttcccttattttgcgctcagatacttcgatctgaaaaaggtctttacgtctttaaggttccatatcgacctggggacttatcactttgcaatttacaaaaagatgatcggagaacagccagaggatcggcatctaacccgcaatctctacggcttcggtaggattcaggactttgccgaggagcacagaccggaggaatggaagcgtctggtgcgggatcttgactatttggagacaggggataaaccctacatctcccagactacccctcactatcatatagaaaagggaaaaattggcctgcgattcgtgccagagggccaacacctctggcccagccctgaagtcgggacaaccagaacgggaaggtcgaagtgtgctcaggacaaacgcctgactgccgaggcattcctttctgttcatgagctgatgccaatgatgttttactatttcttgctccgggaaaagtactccgaggaagtgtcagctgagaaggtacagggtagaatcaaaagggtgattgaggatgtctatgccatctacgacgcgtttgcccgcgatgaaatcaacacactgaaggagttagatacctgcctggcagacaaaggcattcgacgggggcacctacccaagcaaatgataactatcctcagtcaggaacgtaaagacatgaaggagaaaattagaaagaagctgcaggaaatgatcgctgacacagatcacaggcttgacatgttggatcgccagaccgaccggaaaataagaattggaaggaagaatgccggcctgccgaaaagcggtgtgatcgctgattggctcgttcgagacatgatgcgcttccaacctgtggccaaggatgcatccgggaaacccctgaacaattctaaggccaacagcacggagtaccggatgttacagagagctctggcgctttttggcggagagaaggaaaggttgaccccatatttccgtcagatgaatctcacaggcgggaacaatcctcatccctttctgcacgagactcgctgggaatcacataccaacatcctaagtttctaccggtcctatctgagagcaaggaaagcctttctcgagcgaattggacggagcgaccgcgtcgaaaattgtccattcctgcttttgaaggagcccaaaacagatagacagactctggtggctggttggaaggacgagtttcacttacctaggggcatcttcaccgaagccgtacgggattgcctcattgagatggggtacgacgaagttggatcttatcgagaggtgggctttatggcaaaagccgtcccactgtacttcgaaagagcttgtgaggaccgcgtgcaaccgttctatgattcaccctttaacgtcggtaatagtcttaagcctaagaaagggaggttcctgagcaaggaggaccgtgccgaagagtgggaacggggcatggagagatttagggatttggaggcatggtcccattctgcggctcgccgaataaaagacgccttcgcaggaatcgaatacgcctcgccaggcaacaagaaaaagattgagcagctcctgagagatctaagcctgtgggaggcttttgaatccaagctcaaagtgcgggccgacaagatcaacctggcaaaacttaagaaagaaatcttggaggctcaggagcacccctaccacgatttcaagtcatggcagaaatttgaaagggagctgcgcttagttaagaatcaagacattataacatggatgatgtgccgtgatctcatggaagagaacaaggtggaagggctggacaccggaactctttatctgaaagatatcagacctaatgtacaggagcagggtagtctaaacgtcctcaatcgggtgaagccaatgaggctgcccgttgtggtctaccgcgccgactctcgaggccatgtgcacaaagaggcgccgttggccacggtatatattgaagagagaaacacaaagctgttaaaacaggggaatttcaagagctttgtgaaggaccggaggctcaacggactgttctcctttgttgataccggcggtcttgctatggaacaataccctatctcaaaactgcgcgtcgagtatgaattggcaaagtaccagactgccagagtgtgtgtgttcgagctcaccctgaggctagaggaaagcctgctttctcggtatccacatctccccgacgagtccttccgtgaaatgctggagagttggagcgatcctttgctggctaaatggcccgagttacacgggaaggtccgcctcctgattgccgttcgaaatgcattttctcataaccagtacccaatgtacgacgaagcggtgttctcctcaatcagaaaatatgatcctagtagccccgacgccatagaggaaaggatgggccttaatatcgctcaccggctgtcggaggaagtgaagcaagccaaggagacagtagagcgcattatccaggcatga

SEQ ID NO: 11329 - RNA, 3360 nt, synthetic construct
  misc_feature 1..3360: note = Cas13b variant__Porphyromonas gulae__WP_039426176.1__Cas13b
  source 1..3360: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaactttgataatgacctagaacgcaagtcacgactccgtagtctgatccttaaacatttcagctttctggagggggcagcctatggaaagaagttgttcgaatccaaatcttcgggtaacaagtcaagcaaaaataaggagctcactaaaaaggagaaggaagaactgcaggctaacgcactgagtctcgataatttaaaatccattctgtttgacttccttcagaagttgaaagattttagaaactactattctcactacaggcatagcggctcctcagaactgcctctattcgacgggaatatgctccaacggctgtacaacgtctttgatgttagtgtgcagcgcgtaaagagagaccacgagcacaatgataaagtggacccacattatcacttcaaccatcttgtcaggaagggaaagaaggaccggtacggccacaatgataacccgagctttaagcaccatttcgtggactctgagggtatggttaccgaagccgggctgttgttctttgtgtccctcttcctggagaaacgcgatgctatctggatgcagaagaaaattcgaggatttaagggcggcacagggccctatgaacagatgaccaacgaggtcttctgcagatcaaggatcagcttacctaaactgaagctcgaaagtcttcggactgacgattggatgctgttggacatgctaaatgagctggtgcgttgtccaaagcccctctacgatcgcctgagagagaaagacagggcctgctttcgggtacctgttgatatacttccagacgaagatgacacagacggaggtggcgaggatcccttcaagaacaccctggtgcgacaccaagaccgctttccttatttcgcgttgagatactttgatctcaaaaaggtcttcacgtctctgaggtttcatatcgacttagggacttatcacttcgcaatttacaaaaagatgatcggagaacagccagaggatcggcatctgacccgcaatctatacggctttggtaggattcaggacttcgccgaggagcacagaccggaggaatggaagcgtctcgtgcgggatctggactatttcgagacaggggataaaccctacatctcccagactacccctcactatcatatagaaaagggaaaaattggccttcgatttatgccagagggccaacacttgtggcccagccctgaagtggggacaaccagaacgggaaggtcgaagtacgctcaggacaaacgcctgactgccgaggcattcctctctgtccatgagctgatgccaatgatgttttattacttccttctgcgggaaaagtattccgaggaagtttcagctgagaaggtgcagggtagaatcaaaagggtaattaaggatgtgtacgccatctacgacgcgtttgcccgcgatgagatcaacacattgaaagaactcgacgcatgtagtgctgacaagggcattcgacgggggcatctgcccaaacaaatgataggaatcttaagccaggagcacaagaatatggaagagaaagtccgtaagaagctgcaggaaatgattgccgataccgaccacagactagatatgctcgacaggcagactgatcgcaaaatccggataggcagaaagaacgctggtctgccgaaatccggggtgattgccgactggcttgttagggatatgatgcgattccaacctgtggcaaaggacacatctggcaaacccttgaataacagcaaggccaattcaaccgagtatcgcatgctgcagcgggctctcgcgctgtttggaggcgagaaggaaagattaacgccatacttcaggcagatgaacctgaccgggggaaataaccctcacccctttcttgatgagacacgttgggaaagtcatactaatatcttgtccttctatcgcagctacctccgggcaagaaaagcctttctggagaggatcggtcgatctgaccgggtcgaaaaccgcccattcctactgctcaaggagcccaaaaatgatagacagaccctggtggctggctggaagtcagagtttcaccttcctagggggattttcacagaagccgtacgggactgcttgatcgagatgggatatgatgaagttggcagttacaaagaggtgggtttcatggcaaaggccgtcccactgtattttgaacgagcttgtaaggacagagtgcaaccgttctacgacagcccctttaacgtcgggaactccttaaaacctaagaaaggccgcttcctctctaaggagaaaagggccgaggaatgggagtcgggaaaggaacgttttcggctggcaaaacttaaaaaggagattctggaggcgaaagaacatccataccacgatttcaagagctggcagaaatttgagagagaattgaggctcgtgaagaatcaggacataatcacttggatgatgtgccgcgatctgatggaggaaaacaaagttgagggcctagacaccgggacactgtatctcaaggatattcgaaccgacgtgcacgagcagggatccctgaatgtacttaacagagtcaagcccatgcggttgcctgtggttgtgtacagggctgattcacgcggtcatgtccacaaagaacaagccccactggcaactgtgtatatcgaggaacgtgacacgaagttactcaaacagggcaatttcaagagttttgtaaaagatagacggctgaacgggcttttctcttttgtggacacaggaggcctggccatggagcagtaccccatcagcaagctaagggttgaatatgagctcgctaagtaccagaccgcccgcgtctgtgcattcgagcaaactctggaattggaggaatccctgttaacccgatatccgcatctccctgatgagaatttcagagaaatgctggagtcatggagcgacccacttctgggtaaatggcccgacttgcacgggaaggtgcggctcctgattgctgtgaggaacgccttttctcataatcagtaccctatgtacgatgaggcggtcttctccagtatacgcaaatatgaccccagctctccagatgccatcgaagagagaatgggcctaaacattgctcacaggctgtccgaagaggttaagcaggcaaaagagacagtggaacggatcattcaagcctga

SEQ ID NO: 11330 - RNA, 3528 nt, synthetic construct
  misc_feature 1..3528: note = Cas13b variant__Porphyromonas gulae__WP_039418912.1__Cas13b
  source 1..3528: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaacctagataatgacctcgaacgcaagtcacgactgcgtagtcttatcctgaaacattttagcttcttggagggggcagcctatggaaagaagctctttgaatccaaatcttcgggtaacaagtcaagcaaaaataaggagctgactaaaaaggagaaggaagaactgcaggctaacgcactcagtttagataatctgaaatccattcttttcgactttttgcagaagctgaaagatttcagaaactactattctcactacaggcatagcggctcctcagaactacctctctttgacgggaatatgctgcaacggctttacaacgtcttcgatgttagtgtgcagcgcgtaaagagagaccacgagcacaatgataaagtggacccacataggcactttaaccatctggtccggaagggaaagaaggaccgctatggccacaatgataacccgagcttcaagcaccattttgtggactctgagggtatggttaccgaagccgggcttctcttcttcgtgtccctgtttttagagaaacgagatgctatctggatgcagaagaaaattagaggattcaagggcggcacagaaacctaccagcaaatgactaacgaggtcttttgcaggtcacggatcagcctgcccaaactcaagttggaaagtctgcgtatggacgattggatgttgctagacatgctgaatgagctcgtgcgctgtcctaagccactgtatgatagacttagggaggacgatcgggcctgcttccgagtacccgttgacatactgcctgatgaagacgacacagatgggggaggtgaggacccatttaaaaacaccttggtgcgccaccaggatagattcccctactttgcgctcaggtatttcgacctgaagaaagtctttacgtctttacggttccatatcgatctgggcacttaccactttgcaatttataagaaaatgatcggggaacagcctgaggaccgccatctaaccagaaatctctacggattcggcaggattcaggattttgccgaggagcaccgtccagaggaatggaagcggctggtgcgagaccttgattacttcgagacaggtgacaagccgtatatctcccaaactagcccccactaccatatagaaaaagggaagattggattgagattcatgcctgagggccagcacctgtggccatcgcccgaagtgggcaccacaaggaccgggcgctctaaatatgctcaggataagcggctcacggccgaggcatttctgtccgtccatgagcttatgcctatgatgttctactattttctgttgagagaaaaatactcagaggaagttagtgctgagaaggtgcaaggaaggatcaagcgcgtaattgaggacgtgtatgccatctacgatgcgttcgcccgagacgaaatcaacactctcaaagagctggacgcatgtttagctgataagggtattcggcgtggccatctgccaaaacagatgatagccatcctaagccaggaacacaagaatatggaggaaaaagtcagaaagaaactccaggagatgattgctgacacagatcacaggctggacatgcttgatcgccaaaccgaccggaagatcagaatagggaggaagaacgccggattgcccaaatccggcgtgattgcagattggctggttcgagacatgatgcgctttcagccggtggccaaggatgcttctggtaaacctctcaataacagcaaggctaattcaactgagtaccggatgctgcagagagcattagccctgttcgggggcgaaaaagagaggcttacaccctattttcgtcagatgaacttgaccggaggcaataacccacaccctttcctccatgacacgcgctgggaaagtcacaccaatatcctgtccttttaccggagctatctaagagctaggaaggccttcctggagcgaatcgggcggtctgatcgcatggaaaacagaccctttctcctgcttaaggagccaaaaacagacaggcaaactttggtcgcaggatggaagtcagagttccatctgccccggggtatttttaccgaagccgtgcgagattgcttaatcgagatgggctacgacgaagtagggagttatagagaggttggattcatggctaaagccgtgcctctctacttcgaacgcgcatgtgaggacagggtccagccattttatgatagcccgttcaatgtgggcaactccctgaagcccaaaaagggtcgttttctttctaaggaggaacgggcggaggaatgggagagagggaaagagaggttccgcgacctggaagcgtggtcgcacagcgccgcacgaagaattgaggatgcctttgctggcatagaatacgcctcccctggaaacaagaaaaagatcgagcagttgctccgggacctgtcactatgggaagcattcgagagtaaactgaaggtcagggctgataagattaatctcgccaaactgaagaaagagatccttgaagcgcaggagcacccataccatgactttaagtcttggcaaaaattcgaacgcgagttgcgtctggtgaagaaccaggatatcattacatggatgatgtgcagagacttaatggaagagaataaagttgagggcctcgatactgggaccctgtatcttaaggacatacggacaaacgtgcaggaacagggaagcctgaatgtactaaaccacgtcaagcccatgaggctccctgtggttgtgtaccgcgccgattcccgaggtcatgtccacaaagaggaagctccactggcaaccgtgtatatcgaggaaagagacactaagttgctgaaacaaggcaattttaagtcattcgtaaaagaccggaggttaaacgggctctttagcttcgtggatacgggaggcctggccatggagcagtaccccatttctaaacttcgcgttgagtatgaactggctaagtaccagacagccagagtctgtgcattcgagcaaaccttggaactcgaggagtccctgctaactaggtatccgcatctgcctgacaaaaattttcggaagatgcttgaaagttggagcgatccactcctggcgaaatggcccgagttgcacggtaaggtgcgtctgttaatcgccgtgcgcaacgctttctctcacaatcagtaccctatgtacgacgaagccgtcttttcctcaattcgaaaatatgatcccagtagcccagacgcaatcgaggaaagaatggggctcaacatagctcataggctgtcggaggaggttaagcaggccaaggaaaccgtggagcggatcattcaggcatga

SEQ ID NO: 11331 - RNA, 3528 nt, synthetic construct
  misc_feature 1..3528: note = Cas13b variant__Porphyromonas gulae__WP_039434803.1__Cas13b
  source 1..3528: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaactttgataatgacctagaacgcaagtcacgactccgtagtctgatccttaaacatttcagctttctggagggggcagcctatggaaagaagttgttcgaatccaaatcttcgggtaacaagtcaagcaaaaataaggagctcactaaaaaggagaaggaggaactgcaggctaacgcactgagtctcgataatttaaaatccattctgtttgacttccttcagaagttgaaagattttagaaactactattctcactacaggcatagcggctcctcagaactgcctctattcgacgggaatatgctccaacggctgtacaacgtctttgatgttagtgtgcagcgcgtaaagatcgaccacgagcacaatgatgaggtggacccacattatcacttcaaccatcttgtcagaaaaggaaagaaagacaggtacggccacaatgataacccgagctttaagcaccatttcgtggacggtgaagggatggttaccgaggccggactgttgttctttgtgtctctcttcctggaaaagcgggatgctatttggatgcagaaaaagatccgcggctttaaaggcgggacagagacctatcagcaaatgactaacgaagtcttctgccgatccagaatatcattacccaagctgaaactcgagagccttaggatggacgattggatgctgttggacatgctaaatgagctggtgcggtgtcctaagccactctacgatcgtctgcgcgaagacgatagagcctgctttagggtacccgttgacatccttcctgatgaggacgacacagatggaggtggcgaagacccattcaagaacaccctggtgcggcaccaggatcgatttccctatttcgcgttgcgctactttgacctcaaaaaggtcttcacgagtctgagatttcatattgatttagggacttatcacttcgcaatctacaaaaagatgattggagagcagcctgaagacaggcatctgacccggaatctatacggctttggtcgcatccaggatttcgccgaggagcacagaccagaagagtggaaaaggctcgtgcgtgacctggattatttcgaaacaggggacaagccgtacatatctcaaactagcccccactatcatattgagaagggaaaaatcggccttcggtttatgcctgaaggccagcacttgtggccatcccccgaggtggggaccacacgaaccggaagatcgaagtacgctcaggataaaaggctgacggccgaggcattcctctctgtccatgaactgatgcctatgatgttttattacttccttctgcgcgagaagtattccgaagaggtttcagctgagcgggtgcaaggtagaattaaaagggtaatcgaagacgtgtacgccgtctacgatgcgtttgcccgcgacgagatcaacactcgagacgaattggatgcatgtctcgctgacaagggcattcggcgtgggcatctgccaagacagatgatagccatcttaagtcaggagcacaaggatatggaagagaaaattaggaagaaactgcaggagatgatggctgacacagatcaccgcctagacatgctcgatcggcaaaccgacagaaagatcaggataggacgcaaaaatgccggcctgcccaagagcggtgtgattgcagattggcttgttcgagacatgatgcggttccagccggtggccaaagatgcttccgggaagcctttgaacaattctaaggcgaacagcactgaatatagaatgctgcagagggcactcgccctgtttggcggagagaaagaacgtttaacaccctacttccgccagatgaatctgaccggcgggaacaatccacacccttttcttcatgagacgcggtgggaatcacacaccaacatcttgagtttctatagatcctacctcagggctcgaaaggcctttctggagcggatcggacgcagcgacagagtcgagaataggcccttcctactgctcaaagaaccaaagacagatcggcaaactctggtggcaggttggaaaggcgagtttcatcttccccgagggattttcaccgaagccgtaagagactgcttgatcgagatgggacacgacgaagttgcttcttataaggaggtgggcttcatggccaaggcagtccctctgtactttgagcgcgcgtgtgaagatagggtgcagccattctatgactcaccgtttaacgtcggtaatagtttaaaacccaagaaagggcgtttcctcagcaaggaggaacgggctgaggagtgggaaagaggcaaagagaggtttcgcgatctggaagcctggtcctactctgcagcccgaagaattgaggacgctttcgccggaatagaatacgcatcgcctggcaacaagaagaaaatcgagcagcttctgcgggatttgagcctctgggaggcttttgaatccaagctgaaagtgagggccgaccgcattaacctagcgaagctgaaaaaggagatcctcgaagcccaggagcacccatatcatgatttcaagtcatggcaaaaatttgaacgtgagctgagacttgttaagaatcaggacatcattacatggatgatgtgccgggatttgatggaggaaaacaaagtggaggggctggacactggaaccttatacctcaaggatataaggcccaatgtacaggaacagggtagtctgaacgtccttaatcgcgtgaaacctatgcgactgccagttgtggtctatagagctgactctcggggccacgtgcataaggaggaagcacccctagccacagtatacatcgaggagagggacaccaaactcctgaagcaagggaacttcaagagctttgtgaaagatcgcagattgaatggactgttctccttcgttgacactggcggtttagctatggaacagtatccgatttcaaagctcagggtcgagtacgaactggccaaatatcagacggcacgggtgtgtgtgtttgagcttacactgcgtttggaggaaagcctcctgacccgctaccctcacctaccagatgagtctttccgagaaatgctggagtcctggagtgacccccttctcgcgaagtggcctgaactgcatgggaaagtcagattgctgatcgccgttaggaacgcttttagccacaatcaataccccatgtatgatgaggccgtgttctcttccattcggaagtacgacccatcaagtcctgatgcaatcgaggaacgcatgggcttaaacatagctcacagactcagcgaggaagtgaagcaggccaaagagactgtagaaaggatcattcaggcatga

SEQ ID NO: 11332 - RNA, 3528 nt, synthetic construct
  misc_feature 1..3528: note = Cas13b variant__Porphyromonas sp.__WP_039428968.1__Cas13b
  source 1..3528: mol_type = other RNA
atgaccgagcagagcgaaagaccctacaacggcacatattacactctggaggacaagcacttctgggccgcttttctcaatcttgcaaggcataacgcctatatcacgctgacccacattgatcggcaattggcgtactccaaagctgacataacaaatgatcaggacgtgttatctttcaaggccctgtggaaaaactttgataatgacctagaacgcaagtcacgactccgtagtctgatccttaaacatttcagctttctggagggggcagcctatggaaagaagttgttcgaatccaaatcttcgggtaacaagtcaagcaaaaataaggagctcactaaaaaggagaaggaagagttgcaggctaacgcactgagtctcgataatttaaaatccattctgtttgacttccttcagaagttgaaagattttagaaactactattctcactacaggcatagcgaatcctcagagctgcctctattcgacggcaatatgctccaacggctgtacaacgtctttgatgttagtgtgcagcgcgtaaagagagaccacgagcacaatgataaagtggacccacataggcacttcaaccatcttgtccggaaggggaaaaaggaccgctatggacacaatgataacccgagctttaagcaccatttcgtggactctgaaggcatggttaccgaggccggtctgttgttctttgtgtccctcttcctggaaaaacgagatgctatctggatgcagaagaaaattagagggtttaagggaggcacagagacctaccagcaaatgactaacgaagtcttctgcaggtcacggatcagcttacccaaactgaagctcgagagtcttcgtacagacgattggatgctgttggacatgctaaatgagctggtgcgctgtcctaagccactctatgatagactgagggaagacgatcgggcctgctttcgagtacccgttgacatacttcctgatgaggacgacaccgatggcgggggagaagacccattcaaaaacacgctggtgcgccaccaggatagatttccctacttcgcgttgaggtattttgacctcaagaaagtcttcacttctctgcggtttcatatcgatttaggtacctaccacttcgcaatttataagaaaatgatcggcgagcagcctgaagaccgccatctgacaagaaatctatacgggtttggaaggattcaggatttcgccgaggagcaccgtccagaagagtggaagcggctcgtgcgagacctggattacttcgaaactggcgacaagccgtatatctcccaaaccacaccccactaccatatagagaaaggtaagattgggcttagatttgtgcctgaaggacagcacttgtggccaagccccgaggtcggcaccacgaggactggccgctcgaaatatgctcaggataagcggctgacagccgaggcattcctctctgttcatgaactgatgcctatgatgttttactatttccttctgagagagaaatactccgaagaggtgtcagctgagaaggtacaagggaggatcaagcgcgtgattgaagacgtctatgccatctacgatgcgtttgcccgagacgagatcaacaccttgaaagaactcgacgcatgtctggctgataagggtattcggcgtggacacttaccaaaacagatgataggcatcctgagtcaggagagaaaggacatggaagagaaagtgaggaagaaactacaggagatgattgccgatactgaccaccgcctcgatatgctggaccggcaaacagatagaaagatcaggatagggcgaaagaatgctggacttcccaaaagcggcgttattgccgactggttggtgcgcgatatgatgcggttccagccggtcgcaaaggacacctccggtaaacctctgaacaattctaaggccaacagcacggaatacagaatgctccagagggctctggcgttatttgggggcgagaaagaacgtctgaccccctatttccgccagatgaatcttacaggaggcaacaatccacatccttttctgcacgagactcggtgggaatcacataccaacatcctcagtttctacagatcctatctgagggcacgaaaggcctttctagagcggatcgggcgcagcgatagagtggagaattgccccttcctgctcctgaaggaaccaaaaacagacaggcaaactcttgtagctggatggaagggtgagtttcacttgccccggggcattttcaccgaagccgttcgagattgtctgatcgagatggggtacgacgaagtgggatcttatagagaggtcggcttcatggcaaaagccgtgcctttatactttgagcgcgcttgcgaagacagggtccagccattctatgattcaccgtttaacgtgggtaatagtctcaagcccaaaaaggggcgtttcctgagcaaggaggaccgggccgaagagtgggagagaggcaaagaaaggtttcgcgatcttgaggcatggtcccattctgcggctcgaagaattaaggacgccttcgcaggaatagaatacgcctcgcctggcaacaaaaagaaaatcgagcagctgttgcgggatctcagcctgtgggaggcttttgagtccaagctaaaggttagggccgacaaaattaacctggcaaagctcaaaaaggagatcctggaagctcaggagcacccataccacgatttcaaatcatggcaaaagtttgaacgcgagcttcgtttggtgaaaaatcaggacatcattacatggatgatgtgtagagatctgatggaagagaacaaggtagaggggttagacaccggaactctctatctgaaggatatacggcccaatgtccaggaacagggtagtcttaacgtgctgaatagggttaaacctatgcgcctaccagtggtcgtgtaccgagccgactctagaggccatgtacacaaggaggaagcgcccctcgccacggtgtatatcgaggaacgggacacaaaactgttgaagcaagggaacttcaagagctttgttaaagataggcgcctgaatggattattctccttcgtcgacaccggcggtctcgctatggagcagtacccgatttcaaagctgagagtggagtatgaacttgcaaaataccagactgccagggtgtgcgtctttgagctgaccttgcggctcgaagagagcctgctatctcgttatcctcatctgccagatgagtccttccgcgaaatgcttgagagttggagcgaccccctcctggctaagtggcctgaattgcacgggaaagttcgactgttaatcgccgtgagaaacgcattttctcataatcaataccccatgtacgatgaggcggtgttctcctcaattaggaagtatgacccaagtagccctgatgccatcgaagaacggatgggcctcaacatagctcaccgcctgtcggaggaagtaaaacaggccaaggagacagtcgaaagaatcattcaggcatga

SEQ ID NO: 11333 - RNA, 3375 nt, synthetic construct
  misc_feature 1..3375: note = Cas13b variant__Prevotella aurantiaca__WP_025000926.1__Cas13b
  source 1..3375: mol_type = other RNA
atggaggacgataagaaaaccacaggcagcatctcctacgaactgaaggacaaacacttctgggccgcttttctcaaccttgcaagacataatgtgtatattactataaaccacatcaataagctgttggagattagggaaatcgataacgacgagaaagtcttagatattaagacgctgtggcagaaggggaataaagacctaaaccaaaaggcccggctccgcgaactgatgaccaaacatttcccctttcttgagacagcgatctacactaagaataaagaggataagaaggaagttaaacaggagaagcaggctgaagcccagtctctggagtcattgaaagactgcctcttcctgtttctggataagctccaagaggcacgaaactattacagtcactataaatacagcgaattttccaaggagcctgaatttgaggaaggattactggagaaaatgtataatatattcggtaacaatatccagcttgtgattaacgactaccagcataataaggatatcaacccagacgaggattttaagcacttggaccgtaaaggccagttcaagtactcttttgccgacaatgaagggaacattaccgagtcgggactgctattctttgtatcactcttcctggagaaaaaggatgctatctggatgcaacagaaacttaacggcttcaaggacaatctggagaacaagaaaaagatgacacacgaagtgttttgtagaagcaggatattgatgccgaaactccggctggagagtacccagactcaggattggattttactggacatgctcaatgagcttatccgctgccccaagtccctgtatgaaagattgcaaggtgatgacagggagaaattcaaggtcccttttgatccagcagacgaagattacaacgccgagcaggaacccttcaagaatacactaattcggcatcaggaccgctttccttatttcgtgctgcgatactttgattataacgagatcttcaaaaatctcagatttcaaatcgacctggggacctaccacttctctatttataagaaacttataggaggccagaaggaggacaggcatctgacgcacaaattgtacggctttgaacggatccaggagttcgctaagcagaaccgtccagatgaatggaaggccattgttaaagacctcgatacttacgagaccagcaataagcgctatatctccgagacaactccccactaccatctggaaaaccagaaaatagggattagatttaggaatggaaacaaggagatctggccttcattaaaaaccaatgacgaaaacaatgagaagagtaaatataagctggataagcaataccaggcggaagcattcctaagcgtgcacgagctcctgccaatgatgttctattaccttttgctgaaaaaggagaaaccgaacaacgacgaaatcaatgcctctattgtcgagggttttatcaagcgggaaattcgaaacatattcaaactctatgatgcttttgccaatggcgagatcaacaatattgacgatctggaaaagtactgtgcagacaaggggatccccaaacgccatcttcctaagcagatggtggctatcctgtacgatgagcacaaagacatggtaaaggaggccaaaagaaagcaaaaggaaatggttaaagatacaaagaaattgctcgcgaccctggagaagcagacgcagaaagaaaaggaggacgacggaaggaacgtgaagttactgaaatccggcgaaattgcccggtggctagtcaatgatatgatgcgcttccagccagtgcaaaaggacaacgagggtaaacccctcaataactcaaaggcaaatagcactgagtatcagatgctgcagagaagtcttgctttgtacaacaatgaagagaaacctacaaggtattttcgtcaggtgaacctgatagaatctaataacccacatcccttcctcaagtggaccaaatgggaggagtgcaacaatatcctgactttttactattcctacttaacaaagaagattgagttcctgaacaaacttaagccggaagattggaaaaagaatcaatatttcttgaaactcaaggaacctaagaccaaccgggagacgctggtccaggggtggaaaaatggattcaacctaccccgaggcatctttaccgaaccaattagagagtggttcaagaggcaccagaataacagcaaagagtacgaaaaggttgaggccctggaccgcgtgggcctcgtaacaaaagtgatccctctgtttttcaaggaagagtacttcaaggataaagaagagaattttaaggaggacactcaaaaagaaataaacgattgtgtccagcccttctataattttccatacaacgtggggaatatccacaagcccaaagagaaggacttccttcatcgggaagagagaattgaattgtgggataagaaaaaggacaaatttaagggatataaagagaagatcaagtcgaaaaagctgaccgagaaagataaggaagagttcaggtcttacttagaatttcagtcctggaacaaattcgagcgcgagctccgactggttcggaatcaggacattgtgacatggcttctgtgcaaggaattgatcgataaactcaagatagacgagctgaacattgaagaactaaagaaactgcgtctcaacaatatcgacactgataccgctaagaaagaaaagaacaatattctgaacagagtcatgcctatggagcttccagtgacagtatatgagatcgacgattcacacaaaatagttaaggacaagccgttgcataccatctacattaaagaagccgagactaagctgttaaaacaaggtaattttaaggcactcgtgaaagataggcgcctgaacggccttttcagttttgtcaagacgaatagcgaagccgagtccaagcggaaccccatctctaaactgagagtggaatatgagctaggggagtaccaggaagctaggattgagatcatacaggacatgctcgcgctggaagagaagttgattaataaatacaaggatctgcctacaaacaaattcagcgaaatgttaaattcatggctcgagggaaaggacgaggcagataaggcccgattccagaacgacgtcgattttctgatcgctgtgcgcaatgccttcagtcacaaccaatatccaatgcacaataaaatcgaatttgcaaacattaagcccttctccctttacaccgccaataacagcgaggaaaaaggcctgggtatcgctaaccagttgaaggacaaaactaaggagaccacagacaaaattaagaagatagagaaacctatcgaaaccaaggagtga

SEQ ID NO: 11334 - RNA, 3384 nt, synthetic construct; identical to SEQ ID NO: 11284
  misc_feature 1..3384: note = Cas13b variant__Prevotella buccae__EFU31981.1__Cas13b
  source 1..3384: mol_type = other RNA

SEQ ID NO: 11335 - RNA, 3384 nt, synthetic construct
  misc_feature 1..3384: note = Cas13b variant__Prevotella buccae__WP_004343581.1__Cas13b
  source 1..3384: mol_type = other RNA
atgcagaagcaagacaaactgttcgtggatagaaagaaaaacgccatctttgctttccccaagtacattaccataatggagaatcaggaaaaacctgagccaatctattacgaactcacagacaagcacttttgggcagccttccttaacctggcgaggcataatgtctatactacgattaaccacatcaatcggcgcttggagattgctgaattaaaggatgacggctacatgatggatatcaaagggagctggaacgagcaggccaagaaactggacaagaaagttcgactacgtgatctcataatgaagcattttccgttcctggaggcagccgcttatgaaatcaccaattccaagtctcccaacaataaagagcagagagaaaaggagcaatcagaggcacttagtctgaacaatttgaaaaacgtgctctttattttcctggaaaagctgcaggtactcaggaattactatagccactacaaatactccgaggaatctcctaagccaatctttgagacatcgttactgaaaaacatgtataaggtgttcgacgccaatgtccggcttgtgaagcgcgattacatgcatcacgaaaacattgacatgcagagagattttactcacttgaacaggaaaaagcaggttggacggaccaaaaatatcatagactcacccaacttccattatcactttgctgataaggagggtaatatgacaattgccggcctgctattcttcgtgagcctctttctggacaaaaaggacgcgatctggatgcaaaagaaacttaaggggttcaaagatggacgcaacctgcgagagcagatgaccaatgaagtcttttgcagaagtaggatttccttgcctaagctcaaactggagaacgtgcagactaaggactggatgcagttagatatgctgaatgaactcgtacggtgtccaaagtctctttacgagcgtctgcgcgaaaaagacagagagagcttcaaggttccctttgatatcttctccgacgattatgacgcagaggaggagccttttaaaaacacattggtgaggcatcaagatcggttcccatactttgtcctacgatatttcgacctgaatgaaatctttgagcagctccgcttccagattgatctgggcacctaccacttttcaatatacaacaagagaatcggtgacgaagacgaggtgaggcaccttacgcatcacctgtatgggttcgcccggattcaagatttcgctcagcagaatcagccggaggtgtggcgcaaattggtcaaggacctcgattactttgaagccagtcaagagccctatatccctaagactgcaccacattaccacctggaaaacgagaaaataggaattaagttctgcagcacccataataacttatttccctctctgaaaacagagaagacttgtaatggcagatccaaattcaacctaggcacccagtttacagctgaagccttcctctcagttcacgagctgcttcctatgatgttttattacttgctgctcaccaaggactatagcaggaaagaaagtgcggataaggtggaggggatcatccgtaaggaaatttctaacatctacgccatttacgacgcattcgctaatggagagataaactccatcgccgatctgacgtgccggcttcagaaaactaatattctgcagggtcacttgccaaagcaaatgatcagcatcctcgagggccgacagaaagacatggaaaaggaggctgaaagaaaaattggggagatgatagatgacacacagaggcgcctggatttactgtgtaagcagaccaaccaaaagatccggattggaaaaagaaatgccggcctactcaagtcgggtaaaatcgcagactggctggtaaacgatatgatgaggtttcagcccgtgcagaaggaccagaataacattccgatcaataactctaaagccaattccactgaatatcgcatgcttcaacgagctttggcgctgttcgggtcagagaactttcggctcaaggcatacttcaatcagatgaacctggtcggaaatgacaaccctcatccctttttagccgagacacagtgggaacaccaaaccaacatactgagtttctatcgtaattaccttgaggctagaaagaaatatttgaagggcctcaaaccacagaactggaagcagtaccagcatttcctgatcctaaaagtgcaaaagacgaataggaacaccctggttacaggctggaagaatagctttaacctccctcgcgggattttcactcagcccatccgggaatggtttgagaaacacaataactccaagagaatttatgatcagatcctgtctttcgacagggtgggatttgtcgccaaagcaataccactttacttcgccgaagagtacaaggataatgtgcagcccttttatgactaccctttcaacattggtaataaattgaagccacaaaaaggccagtttctggataagaaggagcgagtagaattatggcagaaaaacaaggaactcttcaaaaattatccgagcgaaaagaaaaagaccgacctggcttaccttgattttctgtcatggaagaaattcgagcgcgagttgcggctcatcaagaaccaggacattgttacatggctgatgttcaaagaactatttaatatggccactgtggaggggctgaagatcggagaaatacacctcagagatatcgacaccaacacagcaaacgaggaaagtaataacattctgaataggatcatgcccatgaaacttcctgtcaagacctatgagactgataacaagggcaatattttgaaagagcgtccactggcgacgttctacatcgaagagacagaaaccaaggtgttaaaacaaggtaactttaaggtcctcgctaaagaccgccggctgaatgggcttctgtccttcgccgagactaccgatatagacctagaaaagaaccccattacaaagctcagcgtggaccatgagctgatcaaatatcagaccactagaatctctatttttgagatgacattgggcctggaaaagaaattaatcaataagtaccctacgctcccaaccgattcattcaggaacatgctggagcgatggcttcagtgcaaagcaaatcggcccgaactgaagaactacgttaatagtttgattgccgtgcgcaacgcttttagccacaatcaatatccgatgtacgacgccactctcttcgcagaggtaaagaaatttacactgttcccttccgtcgataccaagaaaatagaactaaacatcgctccacagctgcttgagattgtgggaaaggccatcaaagagattgaaaagtctgagaataaaaactga

SEQ ID NO: 11336 - RNA, 3402 nt, synthetic construct
  misc_feature 1..3402: note = Cas13b variant__Prevotella falsenii__WP_036884929.1__Cas13b
  source 1..3402: mol_type = other RNA
atgaagaacgacaataacagcaccaaatccacagattacactctgggcgacaagcacttctgggccgcttttctcaatcttgcaagacataacgtgtatatcacggtcaatcacattaacaaagttctggagttgaagaataaaaaggatcaggaaataatcattgacaacgatcaagacatcttagccattaagaccctgtgggggaaagtggatacagacatcaataagaaagataggctacgggagctcataatgaagcatttcccctttctggaagcggctacttaccagcagtcttcaaccaacaatacaaaacagaaggaggaagaacaagccaaggcacagagtttcgagagccttaaagactgcctgtttttgttcctcgaaaagctgcgcgaggcccgaaactattactcccactataaacattctaagtcgctggaggagcctaaactcgaggaaaagttactggagaatatgtacaacatctttgataccaatgtacagcttgtgattaaagactatgaacacaacaaggatatcaacccagaggaagacttcaagcacttgggacgtgctgagggtgagtttaattactacttcactagaaacaaaaagggcaatattacagaatcagggctgctatttttcgtcagcctctttctggagaaaaaggacgcaatctgggcccagaccaaaataaagggattcaaggataacagggaaaataaacaaaagatgacgcatgaggtgttctgtcggagtcgcatgcttctgccgaaattgagactcgaatccactcagacccaggactggattctgttagatatgctgaacgagctcatcaggtgccccaagtctctttataaacggctgcagggcgagaagcgcgaaaagtttcgagttcctttcgacccagctgatgaggactacgatgccgaacaagagccctttaaaaatacattggtgagacaccaggacaggttcccttattttgcgctacggtacttcgattataacgaaatttttactaatctgcgtttccagatcgacctcggtacctaccattttagcatctataagaaacaaattggggataagaaagaggaccgccacctgacacacaaactttacggattcgagagaatacaggaatttgcaaaggagaacaggccagacgaatggaaagccctggtcaaggatttggacaccttcgaggagtccaatgaaccctacatctcagagacgactcctcattatcacctcgaaaaccagaaaattggcatccggaataagaacaaaaagaaaaagaagacaatatggccaagtctggagaccaaaactacagtgaatgaacgaagcaagtacaacttaggcaaatcttttaaggctgaggccttcctgtccgtacatgagctactcccgatgatgttctattacctgcttttgaacaaagaggaacccaataacgggaagattaatgcatcaaaggttgaaggaatcatcgagaaaaagattcgcgatatctataaactgtacggtgcttttgccaacgaagagattaataacgaggaggaactcaaggaatattgtgagggcaaagacatagcgatcagacatctgcctaagcagatgattgccatccttaagaatgaatacaaagatatggcaaagaaagctgaggacaagcaaaagaagatgatcaaggataccaaaaagaggctggccgctttggacaaacaggtgaagggggaggtcgaagatggaggccggaacattaaaccactcaagagcggtcgcatagccagttggctggtgaatgacatgatgagattccagcccgtgcagagggatcgtgacgggtaccctttaaacaattctaaagcaaactccacggagtatcaactgctacagcggaccctcgccctgtttggaagcgaacgagagagacttgctccatacttcaggcagatgaatttgatcggcaaggataacccccacccgtttctgaaggacacaaaatggaaggagcacaataacattctctcgttctatcgctcttacctggaagcgaaaaagaactttttaggctccctgaaacctgaggactggaagaagaatcagtatttccttaaattgaaggaacccaaaactaaccgggagaccctcgtccaagggtggaagaatggatttaacctgccaagaggtatcttcacagaacctattagggagtggtttatccgccaccagaatgagtcagaagagtacaaaaaggttaaggatttcgaccgaataggcctagtggcaaaagtaatccccctgtttttcaaggaagattatcagaaagagattgaagactacgtgcagccattctacgggtatccctttaacgtcggaaatatccataacagtcaagagggcactttcctcaataagaaagagcgggaggaactgtggaagggtaacaagaccaaatttaaggattacaaaacaaaggaaaagaataaggagaagaccaacaaagacaagttcaaaaagaaaactgatgaagagaaggaggaatttcgtagctatcttgacttccagtcctggaaaaagtttgagagagaattgaggctggtgcgcaatcaggatattgttacgtggttactctgcatggagctgatcgacaaacttaaaatagatgagctgaacattgaagagttgcaaaagctccggctgaaagacatcgatacagacaccgccaagaaagaaaagaataacattctaaacagaatcatgcctatggagctgccagtgactgtctacgaaaccgacgattctaataacataatcaaggacaaaccgctccacacaatttatatcaaggaggctgagaccaaactgcttaagcaggggaatttcaaagccttggtgaaggataggcgactgaacggcttatttagcttcgtagaaacttcaagtgaggcagaactcaagtccaaacccattagcaagtctctggttgagtacgaacttggagagtatcagcgcgcccgggtggagatcataaaagacatgctgagactagaagagacactcattggcaatgatgaaaagctgcctacgaacaaatttaggcagatgttggacaagtggctggagcataagaaagaaaccgatgacactgatttaaagaatgacgtcaaactcctgacagaggtgcgtaacgctttctcacacaatcaatacccaatgcgcgatcggatcgccttcgcaaacatcaagccctttagtcttagctccgcgaatacctctaacgaggaagggctgggaattgctaaaaagttgaaagacaagacaaaggagactatcgacagaattatagaaatcgaggagcagaccgccacgaaaaggtga

SEQ ID NO: 11337 - RNA, 3402 nt, synthetic construct
  misc_feature 1..3402: note = Cas13b variant__Prevotella intermedia__BAU18623.1__Cas13b
  source 1..3402: mol_type = other RNA
atggaggacgataagaaaaccacagacagcatctcctacgaactgaaggataaacacttctgggccgcttttctcaaccttgcaagacataatgtgtatattactgtcaaccacataaataaggttctggagttgaaaaacaagaaggaccaggatatcattatcgacaatgatcaagacattttagccatcaaaacgcattgggaaaaggtgaacggcgatctgaataaaaccgagaggctacgggaactcatgacaaagcacttcccctttctggagactgcgatatactctaaaaacaaggaggacaaggaagaggtaaaacaggaaaagcaggctaaagcccagtcattcgatagtcttaagcattgcctgtttttgttcctcgagaaactgcaagagacccgcaattattacagccactataagtactccgaatctacaaaagagcctatgctggaaaaggagctcttaaagaaaatgtataacatctttgacgataatattcagctggtgatcaaggactaccagcacaacaaagacattaatccagatgaagacttcaagcatcttgatcgaaccgaggaggactttaactactatttcactcgtaataaaaaggggaacatcacagaatcgggattgctgtttttcgtctcactatttctcgagaagaaagatgcaatatggatgcagcaaaagctgagaggtttcaaagacaacagggaaagcaagaaaaagatgacccacgaggtgttctgtcggagtcgcatgcttctgccgaagttgagactcgaatccacgcagactcaggattggattctgttagacatgctgaatgagctcatcaggtgccccaaatctctttacgagcggctgcagggcgaagatcgcgagaagtttaaagttcctttcgacccagccgatgaagactatgacgctgagcaagaaccctttaagaacaccttggtgcgacatcaggatagattcccttactttgcactaaggtatttcgactacaatgagatttttacaaacctgcggttccagatcgatctcgggacttttcacttcagcatctataaaaagctgattggaggccaaaaggaggaccgtcaccttacccataaactgtacggttttgaacgcatacaggagttcgccaagcagaatagaccagatgaatggaaagctatcgtcaaggacttggatacatacgagacctccaacgagaggtatatttcagaaacgactccccactaccatctcgagaatcagaaaatcgggatacggtttcgaaacgacaatgatgaaatttggcctagtctgaagacaaacggagagaataacgaaaaatcaaagtataagttagacaaacaataccaggccgaggcgttcctgtctgtgcacgagctactcccaatgatgttctattacctgcttttgaagaaagaagaaccgaataacgataagaaaaatgcatccatcgtagaaggctttatcaagcgcgagattagagacatgtataagctgtacgatgccttcgctaacggcgaaatcaacaatattgacgacctcgagaaatactgtgaggataaggggatacccaaaaggcatctgcctaagcagatggttgccatcctttatgacgaacacaaagatatggtgaaggaggcaaagcggaaacagcgcaagatggtcaaagacaccgaaaagctgttggctgccctcgagaaacaaactcaggaaaagacagaggatggaggtagaaacattaggctgttaaagtcaggcgagatcgcgcgttggctggtgaatgacatgatgcggtttcagccagtgcagaaagataacgaagggaatcccctaaacaatagcaaggccaacagtaccgagtaccaaatgctccagcgatctctggcactttataataaagaagagaagcctacgagatacttcaggcaggtcaacttgatcaattccagcaacccacacccctttctgaaatggaccaagtgggaggaatgcaataacattctctcgttctatcgctcttacctgactaaaaagatagagtttttaaataagctgaaaccggaagactgggagaagaaccagtatttccttaaattgaaggaacctaaaacaaaccgggagaccctcgttcaaggatggaagaatggctttaacctgcccagaggtatcttcacagagccaattagggaatggtttaagcgccatcagaatgattccaaagagtacgaaaaggtggaggctctagaccgagtagggctggtgactaaagtcatccctctcttctttaagaaagaagattcaaaggacaaggaggaggatctgaaaaaggacgcccagaaagaaattaacaattgtgtgcaacccttctacagtttcccatataacgttggaaatatccacaagcccgacgagaaagattttcttcatcgggaggagcgtatagaattgtgggacaagaagaaagataagttcaaaggctacaaggctaaagtcaagagcaagaaactgaccgacaaggagaaagaggaatatagatcctacttagagtttcagtcttggaacaagttcgaaagggagctccgcctggtgcggaatcaggatatcgtgacatggcttctgtgcaccgagttgattgacaaactcaaggtagaaggcctgaacgttgaggaactgaaaaagctgagactcaaggatatcgacactgatacggccaaacaggagaagaataacattctgaatagggtgatgcctatgcaacttccagtcacagtgtatgaaatcgacgatagccacaacatagtcaaagaccgaccgttgcacaccgtgtacattgaggagactaagaccaaactgttaaagcaggggaattttaaggcactcgttaaagaccgccggctgaacggacttttctcatttgtggatacaagttccgaagccgagctaaagagcaaccccatctctaaaagcctagtagaatatgagctcggtgaataccagaatgctagaattgagaccatcaaggacatgctgttgctggaggaaactttaatagagaaatacaagaacctccctacagataatttcagtgacatgctgaacggctggcttgaagggaaggatgaggcggacaaagcaaggtttcagaatgatgtcaagctgttggtggccgttcgtaacgctttcagccataatcaatatccaatgcgcaaccggatcgcctttgcaaatattaaccccttctccctctcttcggccgacacgagcgaagagaaaaagctggatatcgctaatcagctaaaagacaagacccacaagattatcaaaagaataattgagatcgaaaagcctatcgagactaaagaatga

SEQ ID NO: 11338 - RNA, 3405 nt, synthetic construct
  misc_feature 1..3405: note = Cas13b variant__Prevotella intermedia__AFJ07523.1__Cas13b
  source 1..3405: mol_type = other RNA
atgaagatggaggacgataaaaagaccaaagaaagcacaaacatgctggacaataagcacttctgggccgcttttctcaaccttgcaagacataatgtgtacatcactgtcaaccacattaataaagttctggagttgaagaacaagaaagatcaggacataatcattgataatgaccaagatatcttagccattaagacgcattgggaaaaagtgaacggcgacctgaataagaccgagaggctacgggaactcatgacaaaacacttcccctttctggagactgcgatctataccaagaacaaggaggataaagaagaggtaaagcaggaaaaacaggctaaggcccagtccttcgactctcttaaacattgcctgtttttgttcctcgagaagctgcaagaggcacgcaattactattcacactacaaatatagtgaaagcacaaaggagcctatgctggaaaaggagctccttaaaaagatgtacaacatatttgatgacaatatccagctggtgattaaagattatcagcacaacaaggacatcaatccagacgaagatttcaaacatcttgaccgaaccgaggaggaatttaactactacttcactacaaacaagaaggggaatattaccgcctccggattgctgtttttcgtctctctatttctcgagaaaaaggatgctatctggatgcagcaaaaactgcgtggtttcaaggacaacagagaatcgaaaaagaagatgacgcacgaggtgttctgtaggtcacggatgcttctgccgaaattgcgcctcgaaagcactcagacccaggattggatactgttagacatgctgaatgagctcattagatgccccaagagtctttatgagaggctgcagggcgaataccggaaaaagtttaacgttcctttcgattccgcagacgaggattatgacgccgaacaagagccatttaaaaatacattggtgcgccatcaggatcgattcccctactttgctctaagatatttcgactacaacgaaatctttactaatctgaggttccagattgacctcgggacctatcacttttctatctacaagaagctgatcggaggccaaaaagaggatcggcaccttacacataagctgtacggtttcgagcgtattcaggaatttgccaaacagaaccgcaccgacgagtggaaggcgatagtcaaagatttcgacacgtatgaaactagcgaggagccttacatctccgaaacagcaccacactatcatttggagaatcagaagattgggatcagatttaggaacgataatgacgaaatatggccctcactcaaaaccaacggagagaataacgaaaagcggaagtacaaactggataagcaatatcaggccgaggctttcttaagtgtgcacgagctgctacctatgatgttctactatctcctgcttaaaaaggaagaaccaaataacgacaaaaagaacgccagcattgtagaaggctttatcaagcgagagatccgcgatatttacaaattgtacgacgcattcgctaatggcgaaatcaacaatattgatgacctggagaagtattgtgaggataaagggataccgaagagacatctccccaaacagatggttgccatcctgtacgacgaacacaaggacatggcggaggaagccaagaggaaacagaaggagatggtgaaagatactaagaaacttctggcaacattggaaaagcaaacccagggagagattgaggacggtggccggaacatccgcctcctgaagtctggggaaatcgctagatggttagtcaatgatatgatgaggtttcagcctgtgcagaaagacaacgagggaaatccactgaacaattccaaggccaactcaacggaatatcaaatgctacagcgtagcctcgctctgtacaataaagaggagaagcccacccggtatttccgacaggtgaaccttattaatagttctaaccctcacccatttttgaaatggacaaagtgggaagagtgcaataacatactgtccttctacagaagctatctcactaaaaagatcgaatttctgaacaagttaaaacccgaggattgggaaaagaatcagtacttcctgaaacttaaggagccgaaaaccaacagggagacattggtccaaggctggaagaatggttttaacctccctcgcgggattttcactgaacccatccgggagtggtttaagagacatcagaatgactcggaagagtacgaaaaagttgagaccctggatagggtggggctagtaacaaaggtgattccactgttctttaaaaaggaggactctaaagataaggaagagtatctcaagaaagacgcccagaaggaaatcaacaattgtgtccaacctttctacggcttcccctataacgtgggcaatatacacaaaccagatgagaaggactttctgccctccgaggagcgcaaaaagttatggggagataagaaatacaagttcaaaggatataaggcaaaagttaagtcaaagaaattgaccgacaaggagaaagaagagtaccgaagttatctggaatttcagagctggaacaagttcgagcgggagttacgtctcgtgagaaatcaggacatcgtcacttggctgctttgcacggaactgattgataaattgaaggtggagggtctcaacgtagaggaactgaaaaagctaaggctgaaggacatcgatacagacaccgccaaacaggaaaagaataacattctcaatcgcgttatgcctatgcaactgccagtgactgtctacgagatcgatgactcccataacatagtgaaagatcggccgcttcacaccgtctacattgaggaaacaaagaccaaattgctgaagcagggcaactttaaggctttagtgaaagacagaaggctcaatgggctgttctcttttgttgatactagctcagagacagaacttaagagtaaccccatctccaaaagcctggtggagtatgaactaggagagtaccagaatgcgcgaattgagacgatcaaggacatgctcctgttggaagagaccctgatagaaaaatataagactttacctacagataacttctctgacatgctcaatggctggctggagggtaaggacgaagcagataaagcccgctttcagaacgacgtaaaacttctggtcgctgtgcggaatgccttctcacacaaccaatacccaatgagaaataggatcgcatttgccaacattaatcccttcagtttgagctccgctgatacctctgaggagaagaagctcgacatcgccaaccagctgaaagataagacacataagattatcaaacgtataattgaaatcgagaagcctatcgaaactaaagagtga

SEQ ID NO: 11339 - RNA, 3399 nt, synthetic construct
  misc_feature 1..3399: note = Cas13b variant__Prevotella intermedia__WP_014708441.1__Cas13b
  source 1..3399: mol_type = other RNA
atggaggacgataagaaaaccaaggaaagcacaaacatgctggacaataaacacttctgggccgcttttctcaaccttgcaagacataatgtgtacatcactgtcaaccacattaataaggttctggagttgaaaaacaagaaggatcaggacataatcattgataatgaccaagatatcttagccattaaaacgcattgggaaaaggtgaacggcgacctgaataaaaccgagaggctacgggaactcatgacaaagcacttcccctttctggagactgcgatctataccaaaaacaaggaggataaggaagaggtaaaacaggaaaagcaggctaaagcccagtccttcgactctcttaagcattgcctgtttttgttcctcgagaaactgcaagaggcacgcaattactattcacactacaagtatagtgaaagcacaaaagagcctatgctggaaaaggagctcttaaagaaaatgtacaacatatttgatgacaatatccagctggtgattaaggattatcagcacaacaaagacatcaatccagacgaagatttcaagcatcttgaccgaaccgaggaggaatttaactactacttcactacaaacaaaaaggggaatattaccgcctccggattgctgtttttcgtctctctatttctcgagaagaaagatgctatctggatgcagcaaaagctgcgtggtttcaaagacaacagagaatcgaagaaaaagatgacgcacgaggtgttctgtaggtcacggatgcttctgccgaagttgcgcctcgaaagcactcagacccaggattggatactgttagacatgctgaatgagctcattagatgccccaaaagtctttatgagaggctgcagggcgaataccggaagaaatttaacgttcctttcgattccgcagacgaggattatgacgccgaacaagagccatttaagaatacattggtgcgccatcaggatcgattcccctactttgctctaagatatttcgactacaacgaaatctttactaatctgaggttccagattgacctcgggacctatcacttttctatctacaaaaagctgatcggaggccaaaaggaggatcggcaccttacacataaactgtacggtttcgagcgtattcaggaatttgccaagcagaaccgcaccgacgagtggaaagcgatagtcaaggatttcgacacgtatgaaactagcgaggagccttacatctccgaaacagcaccacactatcatttggagaatcagaaaattgggatcagatttaggaacgataatgacgaaatatggccctcactcaagaccaacggagagaataacgaaaaacggaagtacaagctggataaacaatatcaggccgaggctttcttaagtgtgcacgagctgctacctatgatgttctactatctcctgcttaagaaagaagaaccaaataacgacaagaaaaacgccagcattgtagaaggctttatcaagcgagagatccgcgatatttacaagttgtacgacgcattcgctaatggcgaaatcaacaatattgatgacctggagaaatattgtgaggataaggggataccgaaaagacatctccccaagcagatggttgccatcctgtacgacgaacacaaagacatggcggaggaagccaagaggaagcagaaagagatggtgaaggatactaaaaagctgcttgcaacattggaaaaacaaacccagggagagattgaggacggtggccggaacatccgcctcctgaagtctggggaaatcgctagatggttagtcaatgatatgatgaggtttcagcctgtgcagaaggacaacgagggaaatccactgaacaattccaaagccaactcaacggaatatcaaatgctacagcgtagcctcgctctgtacaataaggaggagaaacccacccggtatttccgacaggtgaaccttattaatagttctaaccctcacccatttttgaagtggacaaaatgggaagagtgcaataacatactgtccttctacagaagctatctcactaagaaaatcgaatttctgaacaagttaaagcccgaggattgggaaaagaatcagtacttcctgaaacttaaagagccgaagaccaacagggagacattggtccaaggctggaaaaatggttttaacctccctcgcgggattttcactgaacccatccgggagtggtttaagagacatcagaatgactcggaagagtacgaaaaggttgagaccctggatagggtggggctagtaacaaaagtgattccactgttctttaagaaagaggactctaaggataaagaagagtatctcaagaaggacgcccagaaagaaatcaacaattgtgtccaacctttctacggcttcccctataacgtgggcaatatacacaagccagatgagaaagactttctgccctccgaggagcgcaagaaactttggggagataagaagtacaaattcaagggatataaagcaaaggttaaatcaaagaagttgaccgacaaagagaaggaagagtaccgaagttatctggaatttcagagctggaacaaattcgagcgggagttacgtctcgtgagaaatcaggacatcgtcacttggctgctttgcacggaactgattgataagttgaaagtggagggtctcaacgtagaggaactgaagaaactaaggctgaaggacatcgatacagacaccgccaagcaggagaaaaataacattctcaatcgcgttatgcctatgcaactgccagtgactgtctacgaaatcgatgactcccataacatagtgaaggatcggccgcttcacaccgtctacattgaggaaacaaaaaccaagttgctgaaacagggcaactttaaggctttagtgaaggacagaaggctcaatgggctgttctcttttgttgatactagctcagagacagaacttaaaagtaaccccatctccaagagcctggtggagtatgaactaggagagtaccagaatgcgcgaattgagacgatcaaagacatgctcctgttggaagagaccctgatagaaaagtataaaactttacctacagataacttctctgacatgctcaatggctggctggagggtaaggacgaagcagataaggcccgctttcagaacgacgtaaaacttctggtcgctgtgcggaatgccttctcacacaaccaatacccaatgagaaataggatcgcatttgccaacattaatcccttcagtttgagctccgctgatacctctgaggagaagaaactcgacatcgccaaccagctgaaggataaaacacataagattatcaagcgtataattgaaatcgagaaacctatcgaaactaaggagtga

SEQ ID NO: 11340 - RNA, 3381 nt, synthetic construct
  misc_feature 1..3381: note = Cas13b variant__Prevotella intermedia__WP_036860899.1__Cas13b
  source 1..3381: mol_type = other RNA
atggaggacgataagaaaaccacagacagcatcagatacgaactgaaggataaacacttctgggccgcttttctcaaccttgcaaggcataatgtgtatattactgtcaaccacataaataagatcctggaggaaggcgagattaaccgggacgggtacgaaacgaccttgaaaaatacatggaacgagatcaaggatattaataagaaagaccgcttatccaagctgatcataaaacatttcccctttctagaggccgcgacttatcgactcaaccctaccgatacaaccaagcagaaagaagagaagcaagctgaagcccagtctctggagtcacttcgtaagagtttctttgttttcatctacaaactgagagacttgaggaatcactatagccattacaagcactccaaatctctcgagcggccaaagtttgaagagggactgctggagaaaatgtataacattttcaatgcatcgatccgcctcgtgaaggaagattaccagtacaacaaagacattaatccggatgaagactttaagcacttagatagaactgaggaggaatttaactattactttacaaaggacaatgagggtaacatcaccgaatcaggcctgcttttctttgtaagtttgttcctggagaaaaaggacgccatatggatgcagcaaaaactaagggggttcaaggataaccgggaaaataaaaagaagatgacgaacgaggtgttttgccgcagtcgaatgctcctgcccaaacttagactgcagtccactcagacccaggactggattttgctcgatatgctgaatgagttaatcaggtgtcctaagtctctgtatgaacggctccgtgaggaagaccgcgagaaattcagagtcccaattgaaatcgctgatgaggactacgatgcagagcaagaaccctttaagaacacacttgtgaggcatcaggaccggttcccttattttgccctgcgatacttcgattataatgagatctttactaacttgcgcttccagattgacctaggaacctaccactttagcatatacaaaaagcagatcggcgattataaggaatcccatcacctgacacacaaactctacggtttcgagaggattcaagagtttaccaagcagaatagaccagacgaatggcggaaattcgttaagacgtttaactcattcgagactagcaaagaaccctatatccctgagacaaccccacattaccacctggaaaatcagaagatagggattcgcttcagaaacgacaatgataagatctggccgagccttaaaactaactctgagaagaatgagaaatccaagtataaactggacaagtcatttcaagctgaagccttcttgagcgtgcatgagctcctgcccatgatgttttactatttactgctaaaaacagaaaacaccgataatgacaacgagatcgaaacgaagaagaaagagaacaagaatgataaacaggagaagcacaaaattgaagagatcattgaaaacaagataaccgagatctacgcgctctacgacacattcgcaaatggagaaattaagagtatcgatgagctggaggaatattgcaaaggcaaggacatcgagattggccatcttcctaaacagatgatagccatcttgaaggatgaacacaaagtcatggctactgaggccgagaggaagcaggaagagatgctggtggacgtacaaaagtctctcgaatccctggataaccagattaatgaggaaatcgagaacgttgagcgtaaaaatagctcgcttaagtctgggaaaattgcatcctggctggtgaacgacatgatgcggtttcagccagtccagaaggataatgaaggaaaacccttgaacaattcaaaggctaacagtaccgagtaccaactcctgcagcgaacattagccttctttggtagcgaacacgagagactggcgccttatttcaagcagactaaactaatcgaatcctctaatccacatccctttctcaaggacaccgagtgggagaaatgtaacaatatactgagcttctacaggtcatatcttgaagccaagaaaaactttttggagagtctgaagccggaagactgggagaaaaaccagtacttcctcaagctgaaggaacctaaaacaaagcccaaaaccttagtgcaaggctggaagaatgggtttaacctgccacgcggaatcttcactgagcctattcggaaatggttcatgaagcacagagagaatatcacggtggcagaacttaagagggtcggcttggttgctaaagtgattcccctctttttctccgaggaatataaggatagcgtacagccattttacaactaccatttcaatgtgggtaacatcaataaacccgacgagaagaactttctgaattgcgaggaacgccgagagctactgcggaaaaagaaggatgagttcaaaaagatgacagacaaagaaaaggaagagaacccttcttatctcgagtttaaatcatggaataagttcgaacgtgagctgagacttgtcaggaaccaggatatagtgacctggttgctgtgtatggaattatttaataagaaaaagattaaagagctcaacgttgaaaagatctacctgaaaaatattaacactaacaccacaaagaaggagaaaaataccgaggaaaagaacggggaggaaaagaatatcaaagagaaaaacaatatacttaaccgcatcatgccaatgcggctgccgattaaggtgtatggaagagaaaatttcagtaaaaacaagaagaaaaagatcaggcgaaatactttcttcacagtctacattgaggagaaaggcacgaagttgctcaaacagggcaacttcaaggccctggaacgcgaccggagactagggggactgtttagcttcgtgaagaccccctccaaagctgagtctaagtcgaatactatcagcaaactcagggtagaatatgagctgggtgagtaccaaaaggcccgtatagaaattatcaaagatatgcttgcattggagaagacactgatcgacaagtataactccttagataccgacaattttaacaaaatgctcacagattggctggaacttaagggcgagcctgacaaagcctcattccagaatgatgttgacctgctaattgctgtgcgcaacgcgtttagtcacaatcagtacccaatgcggaacagaatcgcattcgccaacattaatcccttttctctcagctccgctaacacttcagaagagaaggggctgggaatagccaatcaattgaaagacaagacccacaagacgatcgagaaaattatcgaaattgagaagcctatcgaaaccaaagagtga

SEQ ID NO: 11341 - RNA, 3363 nt, synthetic construct
  misc_feature 1..3363: note = Cas13b variant__Prevotella intermedia__WP_061868553.1__Cas13b
  source 1..3363: mol_type = other RNA
atggaggacgataagaaaaccacagacagcatcagatacgaactgaaggataaacacttctgggccgcttttctcaaccttgcaaggcataatgtgtatattactgtcaaccacataaataagatcctggaggaagacgagattaaccgggatggctacgaaaatacgttggagaactcctggaatgagatcaaagacattaacaagaaggatcgcttatctaaactgatcataaagcatttcccctttctagaagccaccacatatcgacagaatcctactgacaccacaaaacaaaaggaggaaaaacaggcggaggctcagtcactcgagagtctgaaaaagagcttctttgttttcatctacaaacttcgtgatctgagaaaccactattcccattacaagcactctaaatcgttggaaaggccaaagtttgaggaagacctccagaataaaatgtataacattttcgatgtgtcaatccaatttgtaaaggaggactacaaacacaataccgatattaacccgaagaaggacttcaaacatctggaccggaagcgcaaagggaagtttcactacagcttcgccgataatgaaggaaacatcactgagagtggtctgctctttttcgtgtccttattcctggagaaaaaggacgcaatatgggtccagaagaaacttgaaggctttaagtgctctaacaaaagctatcagaagatgacaaatgaggtgttctgtagatccaggatgttgctgcccaaactacggctcgaatcaacccagacgcaagattggattctgcttgacatgctgaacgagttgatccgctgccctaagagtctctacgaacgactgcagggggttaatagaaagaaattttatgtgagcttcgatccagccgacgaggattacgacgctgagcaggaaccctttaagaacactttagtcaggcatcaggatcggttcccttattttgcactgcgttacttcgactataatgaggtgtttgccaacctccgcttccaaattgatcttggaacctaccacttttctatctacaaaaagctgatcggcggtcagaaagaagacagacacttgacacataagctatatgggttcgagaggattcaggaatttgacaagcaaaatcggccagatgagtggaaagctatagtaaaggactccgatactttcaaaaagaaagaggaaaaggaggaagagaaaccctacatctcagagaccacacctcactatcatctggaaaacaagaagattggaatcgccttcaaaaatcacaacatatggccaagcacccagacggagctcactaataacaagcgaaagaagtacaatctgggcacaagtattaaagcggaagcatttctttctgttcatgagctgttgccgatgatgttctattacctcctgttaaagaccgaaaacactaagaatgacaacaaagtgggcgggaagaaagagacaaagaaacagggaaagcacaagatcgaggccatcattgaatccaaaatcaaggatatttatgctctgtacgacgcctttgcaaacggtgagataaatagcgaagatgagctaaaagaatacctcaagggcaaagacatcaagattgtccatctgcccaagcagatgatcgctatccttaaaaacgagcacaaggatatggccgagaaagcggaagccaagcaagagaaaatgaagttggcaaccgaaaatcgcctgaaaacgctcgacaagcagctgaaggggaaaattcagaacggaaagagatataattcggctcctaaatctggcgagatagcctcctggcttgtgaacgatatgatgaggttccagccagtgcaaaaggacgaaaatggtgagtcactgaacaatagtaaagctaacagcaccgagtaccagttgctccagcggacactggcctttttcgggtccgaacacgagcgcttagcaccctattttaagcagactaagctgatcgaatctagcaatcctcatccattcctaaacgataccgagtgggagaaatgttcaaatattctcagtttttacagatcctatctgaaggccaggaaaaacttccttgagagcttgaagcccgaagactgggaaaagaatcaatactttctgatgctcaaggagccgaagacaaaccgtgaaactctggtccagggatggaaaaacggcttcaatttacctcggggctttttcaccgagcccatccgaaagtggttcatggagcactggaaatctattaaggttgacgatctgaaaagagtggggcttgtagctaaggtgacaccattgtttttctcagaaaagtataaagacagtgtccagcctttttacaactaccccttcaatgtgggagatgttaacaagccaaaagaggaagactttctccacagggaggaacgcatcgagctgtgggataagaaaaaggacaagttcaaaggttataaggcgaaaaagaaatttaaggagatgaccgataaagaaaaggaggaacatcggagctacctagagttccagtcctggaataagtttgaaagagagctgaggctcgtgcgcaaccaagacatagtcacttggctgctttgcacggagttgatcgataaactgaagattgacgaattaaatatcaaagagctcaagaaactgcgacttaaggatattaacacagacaccgcaaagaaagaaaagaataacatcctgaatcgggtgatgcccatggagttgcctgtaactgtttataaagtgaacaagggcgggtacataattaaaaataagccactccacaccatctatattaaggaggccgaaacaaaactgctaaagcagggaaacttcaaagctctggtcaaggatcgtagactcaatggcctgttttctttcgtgaaaaccccgtcggaggccgaaagcgagtccaaccccatctcaaaacttagggtcgaatacgagttgggtaagtatcagaacgcacgcctggacataatcgaggacatgttagccctcgagaaaaagctgattgataaatacaatagtcttgacactgataacttccataatatgctgacagggtggctagaactcaagggcgaagctaaaaaggcccggtttcaaaacgacgtgaaactgttgacggcagttagaaatgcgttctctcacaaccagtaccctatgtatgatgagaatctgtttggaaacatcgaaaggttcagcttatcctcaagcaatattatcgagtctaagggcctcgacatagctgccaagctgaaagaggaagtgtccaaggcagccaaaaagattcagaacgaggaagataataaaaaggagaaggaaacctga

SEQ ID NO: 11342 - RNA, 3378 nt, synthetic construct
  misc_feature 1..3378: note = Cas13b variant__Prevotella intermedia__KJJ86756.1__Cas13b
  source 1..3378: mol_type = other RNA
atgaagatggaggacgataaaaagaccacagaaagcactaacatgctggacaataaacacttctgggccgcttttctcaaccttgcaagacataatgtgtacatcacggtcaaccacattaataaggttctggagttgaaaaacaagaaggatcaggacataatcattgataatgaccaagatatcttagccattaaaacccattgggaaaaggtgaacggcgacctgaataaaacagagaggctacgggaactcatgactaagcacttcccctttctggagaccgcgatctatacaaagaacaaggaggataaggaagaggtaaaacaggaaaagcaggctgaggcccagtcccttgagtctctgaaagactgcttgttcctctttctggaaaagctgcaagaggcacgcaattactattcacattacaaatatagtgaaagcaccaaggagcctatgctcgaagaggggttactggagaaaatgtacaacatattcgatgacaatatccagcttgtgattaaggattatcagcacaacaaggacatcaatccagacgaagattttaaacacttggaccgaaagggacagttcaaatactcctttgccgataacgagggtaacattactgaatctggcctgctattctttgtctcactcttcctggagaagaaagacgctatctggatgcaacagaaacttacagggtttaaggataatcgtgaatcgaaaaagaaaatgacccatgaggtgttctgtagaaggcggatgctgttgccgaagctccgcctggagagcacgcagactcaggactggatattactggatatgctcaacgaacttattagatgccccaaaagtctgtacgagaggttgcaaggagaatatcggaagaagttcaatgttccttttgactccgcagatgaggactacgatgccgaacaggagccattcaaaaacaccctagtgcgccaccaggaccgatttccctatttcgctctgagatactttgactataatgagatcttcacaaacctcaggtttcaaattgatctgggcacttaccatttctctatctataagaaacttatcggtgggcagaaggaagaccggcacctgacccacaaattgtacggatttgagcgtattcaggagttcgccaagcagaatcgccctgatgaatggaaggcgctcgtcaaagacctggatacatacgagaccagcaacgaaagatatatatccgagacgactccacattaccacttagaaaatcaaaagatcggcattaggtttcggaacggcaataaagagatctggccctcactgaagacaaacggggaaaataacgagaaaagtaagtataaactagacaagccttaccaggcagaggccttcctcagcgtgcatgaactgcttccaatgatgttttattacttgctgctcaagaaagaggaaccgaataacgataagaaaaacgcttctatagtagagggattcattaagcgagaaatccgcgacatgtataaactgtacgatgccttcgcaaatggtgagatcaacaatattggcgaccttgagaagtactgtgaagataaggggatccccaaaagacatctgcctaagcagatggttgctattttgtatgacgagccaaaagatatggtgaaggaagccaaaaggaagcagaaggagatggtcaaagacaccaagaaactcctggcgactttagaaaagcaaacacaggaggagatagaagacggaggccggaacatccgcctgctaaaatccggtgagattgccagatggctcgtgaatgatatgatgaggtttcagcccgtgcagaaggacaacgaagggaatcctctgaacaattcaaaggcaaacagcaccgagtaccaaatgcttcagcgtagtttggctctgtataataaagaggaaaagccaacgcggtacttccgacaggtcaacctcatcaattcttccaacccccacccgtttctgaaatggaccaagtgggaggaatgcaataacatccttagcttctatagaaactacctgactaaaaagattgagtttcttaataaattgaagcctgaagattgggagaagaaccagtatttcctcaaactgaaggagcccaaaacaaatagggaaaccctagttcaaggatggaagaacggctttaatctgccacgcggcatattcacagagcctatccgggaatggtttaaaagacaccagaacgactcgaaggagtacgaaaaggtggaggccctcaaaagggtagggctggtgactaaggtcattccccttttctttaaagaggaatacttcaaggaggatgctcagaaagaaatcaataactgtgtgcaaccattttattctttcccctacaatgttggaaacattcacaagcctgacgagaaggatttcttgccatccgaggaacgcaaaaagctgtggggtgacaaaaaggataaatttaagggctataaggccaaagtgaagagtaaaaagttaaccgacaaagagaaggaagagtaccgatcatatctcgagttccagagctggaataagtttgaacgggagctgcgtcttgtcagaaaccaggatatcgtgacatggctgttgtgcaccgaactcatagacaaaatgaaggtagaggggctgaatgttgaggaactacagaaactgaggctcaaggatatcgacactgacacggcaaaacaagaaaagaacaatattctgaaccgcatcatgccgatgcagcttcccgtgacagtctacgagattgatgactcccataacatcgtgaaagatcggcctttgcacaccgtctatatagaggaaactaagaccaagctgttaaaacagggaaatttcaaggccctcgtgaaagacagaaggctgaacggcttattttctttcgttgatacaagctcaaaggctgagctgaaagacaagccaattagtaagtccgtggtagaatacgagctaggtgaataccagaatgcgcgaatcgagaccattaaagatatgctcctgttggagaagactctgatcaaaaagtatgaaaaattacccacagacaactttagcgatatgctcaatgggtggctggagggcaaggacgaatctgataaggcacgcttccaaaacgacgtcaaacttctggtggccgttcggaatgctttttcacataaccagtaccctatgagaaataggatagccttcgcaaacatcaatccatttagtttgagctccgccgacatttctgaggaaaagaaactcgatatcgctaaccagctgaaggacaaaacgcacaagattatcaagaaaataattgagatcgagaagcccatcgaaaccaaagagtga

SEQ ID NO: 11343 - RNA, 3378 nt, synthetic construct
  misc_feature 1..3378: note = Cas13b variant__Prevotella pallens__EGQ18444.1__Cas13b
  source 1..3378: mol_type = other RNA
atgaaggaggaagagaaaggcaagacccccgtggtcagcacatacaacaaagacgataagcacttctgggccgcttttctgaatctcgcaagacataacgtttatatcactgtgaatcacattaacaaaatacttggggaaggagagatcaatagggacggttacgaaaacacgctggagaagtcctggaatgagattaaggatatcaacaaaaaggaccggttgtctaaattaattatcaagcatttcccttttctggaagtaaccacatatcagcgcaattcagccgatactaccaaacaaaaggaggaaaagcaggcggaggctcagagtctagagagcctcaaaaagtccttctttgtgttcatatacaaactgcgagaccttcgtaaccactattctcattacaagcactcgaaatcactggaaagaccaaagtttgaggaagatttgcaggagaaaatgtataatatcttcgacgccagcattcaactcgtcaaggaagattacaagcacaacacagacatcaaaaccgaggaggattttaagcatctggacaggaaaggccagttcaagtacagttttgcagataatgaagggaacattactgagtccggactcctgttctttgtgtctttattcctggagaaaaaggacgccatctgggttcagaagaaacttgaaggcttcaagtgcagcaatgaatcctatcagaaaatgacaaacgaggtgttttgtcggtcacgcatgttgctgccgaagctaagactccaaagtacccagacgcaggactggatactgcttgatatgctgaacgagttgattaggtgccccaaaagcctctacgaacggctgcgcgaggaagaccgaaagaagttcagagtccctatcgagattgctgatgaagactatgatgcagagcaggagccatttaaaaatgccttagtgaggcaccaagaccggttcccctactttgctctgcgttatttcgattacaacgaaatctttactaatctccgcttccagatcgaccttggtacctatcatttttctatttacaagaaacagataggggattacaaggagtcccaccacctgacacataaattgtatggattcgaaagaatccaagagtttactaagcagaacaggcctgacgagtggcggaagttcgtaaaaacctttaattcattcgaaacaagcaaggagccatacattcccgaaaccacgcctcactatcatctagagaaccagaaaatcggcatacgattccgcaatgataacgacaagatttggccaagtctgaaaactaattctgaaaagaacgagaaatccaagtacaagctcgacaagagctttcaggccgaggcgttcctgtcggttcacgaacttctgccgatgatgttttattacttgctcctgaaaacagagaataccgataacgacaatgaaatcgagactaaaaagaaagaaaacaagaatgataagcaagagaaacataagatcgaggaaattatcgagaacaaaattacagaaatatatgcattatacgacgccttcgctaacggcaagatcaattctattgataaactggaggaatactgtaaggggaaggacatcgagatcggacacctacccaaacagatgattgccatactcaagtccgagcacaaagatatggcaaccgaagctaagagaaaacaggaggaaatgctggccgacgtgcagaagtcacttgagagtttggataaccaaatcaatgaggaaattgagaacgtcgaaaggaagaatagctccctgaaatctggtgagatcgcgagctggctcgtgaacgacatgatgcggtttcagcctgtgcagaaggataatgaaggcaacccactgaataactcaaaagccaatagtacggagtatcagatgcttcaacgctccctggcattgtacaacaaggaggaaaaacccaccagatatttcaggcaggtcaatctcattgagagctctaaccctcatccatttctgaataacacagaatgggagaagtgcaacaatatcttatcattctaccgtagttatctggaagctaaaaagaactttctagagagcctcaagcccgaggactgggagaaaaatcagtacttcctgatgcttaaggaaccgaaaactaactgtgaaaccttggttcaggggtggaagaatggatttaacctgcctcggggcatattcacagagcccatccgaaaatggtttatggaacacagaaagaatattactgtggccgagctcaagagggtaggtctggtggctaaagtcatcccattattcttctccgaggaatataaggattctgtgcaacctttttacaactacctgttcaatgttgggaacattaataaacccgacgagaagaactttcttaattgcgaggaacgccgggagttgctcaggaaaaagaaggacgagttcaaaaagatgaccgataaagaaaaggaagagaacccatcgtatctggaatttcagagctggaataaattcgagagagagctacgcctggtgcgaaaccaggacatcgtcacatggctcctgtgtatggaactttttaacaagaagaaaataaaggagttgaatgtggagaaaatttacctgaagaacatcaataccaacactacgaaaaaggaaaagaatacagaagagaaaaacggagaggaaaagattatcaaagagaagaataacatattaaatcggatcatgcccatgcgtctccctattaaagtatatggcagagaaaacttctccaagaataaaaagaagaaaatcaggcgcaacacctttttcactgtttacattgaggaaaagggcaccaaactgcttaagcaagggaattttaaagccctggagcgggatagaaggttgggaggtctcttctcattcgtgaagacacatagtaaggcagagtctaaaagcaacaccatctccaagtcacgagtcgaatatgagctgggcgaataccagaaagcccgcatagagattatcaaggacatgctagctctggaggaaactctcatcgataaatataatagcctggacacagataactttcacaatatgcttacggggtggttgaagctgaaggacgagccagataaagcgtctttccagaacgacgtggatttactcattgcagtccggaacgccttttcccacaatcagtacccgatgagaaacaggatcgctttcgccaatattaacccctttagtctgagctctgcaaatacctccgaagagaagggacttggcatagccaaccaactgaaagacaagactcataaaacaatcgaaaagattatcgagattgagaagcctatcgaaaccaaagagtga

SEQ ID NO: 11344 - RNA, 3453 nt, synthetic construct
  misc_feature 1..3453: note = Cas13b variant__Prevotella saccharolytica__EKY00089.1__Cas13b
  source 1..3453: mol_type = other RNA
atgatggagaaggaaaacgtgcagggcagccacatctactatgagcccaccgacaaatgcttctgggccgctttttacaatctggcaagacataacgcctatctcacaattgcgcacataaattccttcgtcaactctaagaaagggatcaataacgatgacaaggttcttgatattatcgacgattggtcaaaatttgacaatgatctgttgatgggagctaggttaaacaagctgattctaaagcatttcccttttctcaaagccccactgtaccaacttgcaaagcggaaaactcgcaagcagcagggtaaagaacagcaagactatgagaagaagggcgatgaagacccggaggtgatccaggaggccatagctaatgcattcaaaatggccaacgtacgaaagacgctgcacgcctttttgaaacagctcgaagatctgcgtaatcatttcagtcactacaactataatagccccgctaagaaaatggaggtgaagtttgacgatgggttctgtaacaaactgtactacgtctttgacgcggcactccagatggtgaaggacgataatagaatgaaccctgaaatcaacatgcaaaccgacttcgagcacttagttaggctgggacggaatcgcaagattccaaacacatttaaatataatttcactaactccgatggcaccatcaataacaatggtcttttgttctttgtgtctctgttcctagagaagagagacgccatttggatgcagaaaaagatcaaagggtttaagggaggcacagaaaactacatgaggatgaccaatgaggtcttctgccggaaccgcatggtgatacccaagctccgactggaaactgattatgacaatcatcagcttatgtttgatatgctgaacgagttggtaagatgtcctctctcgctgtacaaaaggttaaagcaggaagaccaagataaattccgggttccaattgagtttctggacgaggataatgaagctgacaacccctatcaggagaatgccaactcagacgaaaaccctacagaggaaaccgatccactcaagaatacgcttgtgcgtcaccagcatcgcttcccgtactttgtcctgagatatttcgacttgaacgaggtgtttaaacaactaaggttccagatcaatctgggctgctaccactttagcatttacgataagactatcggggagcggaccgaaaagcgacacctcacacgcactctgttcggattcgacagacttcagaactttagtgtgaaactgcagcccgagcattggaagaatatggtcaaacacttggataccgaagagtcctctgacaagccttatctcagcgatgcaatgccacattaccaaatcgaaaacgagaaaattggtatacacttcctgaagacagacaccgagaagaaagaaacggtttggccctccttagaggtggaagaggtatcaagtaataggaacaagtataaaagcgagaagaatctgactgctgatgcctttctatctacacatgaactcctgcctatgatgttctactatcagcttttgtcctcagaggagaaaacccgggcggccgcaggcgacaaggtgcagggggtcctgcagagctaccgcaaaaagatctttgatatttatgacgatttcgctaacggaactatcaatagtatgcaaaagctcgacgaaagactggccaaagacaaccttctgaggggcaatatgccacagcagatgttggctatactcgaacaccaggagcccgatatggagcaaaaggccaaagaaaagctggaccgtttaattacagagaccaaaaagcggatcggtaagctggaagatcagtttaaacagaaggtgcgaatcgggaaaagaagggcagacctaccgaaggttggatctattgccgattggctcgtgaacgacatgatgcgcttccagcctgctaaacggaatgcggataacacgggcgtccccgactccaaggcaaacagcaccgagtacagactgcttcaagaagccttggctttttactcggcctataaggataggctggagccatacttccgccaggtgaatctcatcggcgggacaaaccctcacccctttctgcatcgagtagactggaaaaagtgtaatcacttactgtctttctatcatgattaccttgaggcaaaagaacagtatttgtcccacctctcaccagccgactggcaaaagcaccagcattttctgctactgaaagttcggaaggatattcagaacgagaagaaagactggaagaaaagtctcgtggctggatggaagaatggtttcaacctgccccgtggccttttcactgaaagcataaaaacctggttttccacagacgccgataaggtccagatcactgacaccaaattgttcgagaatagagtggggctgattgcaaagttaatccctctctactatgataaggtctacaacgacaaaccacaaccgttttaccagtatcccttcaatatcaacgataggtacaagcctgaagacacacgcaaacggtttaccgcggcttctagcaagctgtggaatgagaaaaagatgctttataagaacgcccagccagattcaagtgacaaaattgagtacccccagtatctggatttcttgtcctggaagaaactcgaaagagagctgaggatgctacgaaatcaagacatgatggtgtggctgatgtgcaaggatctctttgcacagtgtactgttgaaggagtggagttcgccgacctgaaacttagccagttggaggtagacgtcaacgtgcaggataatctgaacgttttaaacaatgtgtcttcaatgatactccctctgagtgtctacccaagcgacgctcaaggcaacgtgcttcgcaattccaagcccctgcacacggtatatgtgcaggaaaacaatacaaagctactcaaacagggtaactttaagtctctgttgaaagatcggagactgaatgggttattctcgtttatcgccgcagagggcgaagacctccaacagcatccgctgaccaagaacaggcttgagtacgaactgagcatttaccagactatgcgtatctccgttttcgagcagaccttgcaactcgagaaagctattctgacacgcaataagaccctatgcggaaacaatttcaacaatctgcttaactcatggagtgaacaccggactgataagaaaacactccagcctgacatcgattttctgatagccgtcagaaatgcgttctctcataaccagtatccaatgagcacgaataccgtgatgcagggcatcgagaagtttaacattcaaactcccaaattggaagagaaggacgggctgggaatcgcctcccagttagctaaaaagacaaaggatgcagcctcaaggctccagaacattatcaatggtggcaccaactga

SEQ ID NO: 11345 - RNA, 3969 nt, synthetic construct
  misc_feature 1..3969: note = Cas13b variant__Prevotella sp.__WP_036929175.1__Cas13b
  source 1..3969: mol_type = other RNA
atgagcaaggagtgcaaaaagcagagacaagaaaagaagaggcggctgcagaaagccaacttctccatctctctcaccggcaagcacgtgtttggggcttacttcaatatggcacgcacaaactttgtcaagactattaattatatacttcccatcgccggagttcgaggtaactactcagagaatcagattaacaaaatgctgcatgcgttgttcttaatccaggctggccgtaatgaagaactgacgaccgaacaaaagcagtgggagaaaaagctaagactcaaccctgagcagcagacaaaatttcaaaagctgcttttcaagcactttccagtgctggggccgatgatggccgacgtagcagatcataaagcctatttgaataagaaaaagagtactgtgcagaccgaagacgagacattcgctatgctcaaaggagtcagcctggcagattgtctggacattatctgcctcatggccgataccttaactgaatgtaggaacttttacacacacaaggacccctataataaaccttcccagctggctgatcagtaccttcatcaagagatgatagccaagaagttggacaaagtggttgtggcgtctcggcgcatcctgaaggatagagagggcctatcggtcaacgaagtggagttcctcaccggtattgaccatctgcaccaggaagtacttaaagatgagtttgggaatgcaaaggttaaagacggaaaggtgatgaagacgttcgtcgaatatgatgacttttacttcaaaatctcaggcaagaggctggtgaacggctacactgtgaccacaaaagacgataagccagtcaatgttaacactatgttgcccgccctcagcgacttcgggctgttatatttttgcgtgctgttcctcagtaaaccttacgctaagttatttattgatgaggtacggctgttcgagtattccccatttgacgataaggaaaacatgatcatgtctgagatgttgagcatataccgcattcgaacccccagactacacaaaatcgactcccacgattcaaaggccacactggcaatggacattttcggagaactcaggcggtgtcctatggagctgtataatcttctggataaaaacgctggtcagccatttttccatgacgaagtgaagcacccgaatagtcacacccccgatgtcagcaaacgtttgcgctacgacgacagatttcctacgctcgccctgaggtatatcgatgagactgagttattcaagcggatccgatttcaactgcagctaggctctttccgctacaagttttacgacaaagaaaactgcattgatgggagagtgagggttcggcgcatacagaaggagatcaatggatatggcagaatgcaggaagtggcggacaaaaggatggataagtggggtgacctcattcaaaaacgtgaggaacggtccgtcaagctggagcatgaggaactttacatcaacttggatcagttcctggaggacacagccgattcaaccccatatgtgactgaccgaagacccgcatacaatatacacgctaacaggattgggctctattgggaagatagccagaatcctaaacagtacaaggtattcgacgagaacggaatgtatatcccagagctggttgtgacagaagataagaaagcccccatcaagatgccggctcctcgctgtgcccttagtgtctacgacctgcccgcaatgttgttttacgagtatctccgggaacaacaggacaatgagttcccatctgccgaacaggtgattatcgagtacgaggatgactatagaaaatttttcaaggctgtcgcggaaggcaaactgaagccttttaagaggcccaaagagttccgcgattttcttaagaaagaatacccaaagctgcgaatggcagacattcccaaaaagctacaactcttcctgtgctcccatggcctttgttataacaataagcctgagaccgtgtacgaacggttggatcgtctgacgctccagcacctggaggagagagaattacatatacagaacaggctggagcactatcagaaagaccgcgatatgatcgggaataaggacaaccagtacggtaaaaagagcttttcggatgttcggcacggagcccttgctagatacttggcccaatctatgatggaatggcagccaaccaaactcaaggacaaggagaaaggccatgataagctgacagggctaaactataatgtgctgactgcatacctcgccacctatggacacccgcaggtacccgaagagggcttcacacctaggactctggagcaagtccttattaacgctcatttgatcggtgggtccaatccacacccctttatcaacaaagtgctggccttaggcaatcgaaacattgaggagctctacctgcactatcttgaagaggagctgaagcatatacgctcacggatccagagtttgagctccaatccttctgacaaagcactcagcgcgctgccattcattcaccatgatagaatgaggtaccacgaacgtacctcagaggaaatgatggctctagccgcacgctatacaaccatccagctgcccgacggactctttactccgtacattctggagatccttcagaagcattacacggaaaacagtgacttgcaaaatgccctgtcccaggatgttcctgtgaaattaaacccaacatgcaatgctgcctatctcataaccctgttctaccagactgtccttaaggacaacgcacagcccttctatctgagcgataagacctacacacggaataaagacggcgagaaggctgagtctttttcattcaaaagagcctatgaactatttagtgtgctcaacaataacaagaaagataccttcccttttgagatgatccccctgttcttgactagcgacgaaattcaagagaggctgtccgcgaagttactcgatggggacggaaacccagtacctgaagtgggtgagaagggcaaacccgccacagattctcaggggaatacgatctggaagcgacggatttactcggaggttgacgattatgctgaaaaactgaccgaccgcgacatgaagatcagctttaaaggagagtgggaaaaacttccaagatggaagcaggataaaataattaagaggcgggacgagactcgaagacagatgcgcgatgaactgttgcaaaggatgccgcgttacatccgggacattaaagataacgagagaacactcaggcgctacaagacccaggacatggtcctgttcctactggcagagaaaatgtttacaaatatcatatccgaacagtcaagtgagttcaactggaagcaaatgcgactttctaaggtgtgtaatgaagcctttctcagacagactctgaccttccgggtgcctgtcacggttggcgagaccacaatctatgtggagcaggaaaacatgagcttgaaaaattacggtgagttctataggtttctgactgatgaccgcttaatgtccctcctgaacaatattgtggaaacccttaagcccaacgagaatggggatctggtaatccgtcacacagacttgatgtcagaactcgctgcctacgatcagtatagaagcactattttcatgctgatccaatctatagagaacctaattatcaccaataacgcagtcctggacgatccagacgcggacggcttttgggtgcgggaggatcttcccaaaaggaataacttcgcctccctcctggaattgatcaaccagttaaataacgttgagctgacggacgatgaacgcaagctcctggtggctattcgaaatgcctttagtcacaacagctacaatatcgacttctctcttattaaagatgtcaagcatctgcctgaggtggcaaagggaatattgcagcacctacagtccatgctgggcgttgaaatcacaaaatga

SEQ ID NO: 11346 - RNA, 3384 nt, synthetic construct
  misc_feature 1..3384: note = Cas13b variant__Prevotella sp.__WP_007412163.1__Cas13b
  source 1..3384: mol_type = other RNA
atgcagaagcaagacaaactgttcgtggatagaaagaaaaacgccatctttgctttccccaagtacattaccataatggagaatcaggaaaaacctgagccaatctattacgaactcacagacaagcacttttgggcagccttccttaacctggcgaggcataatgtctatactacgattaaccacatcaatcggcgcttggagattgctgaattaaaggatgacggctacatgatggggatcaaaggaagctggaacgagcaggccaagaaactggataagaaagttcgactacgtgacctcataatgaagcattttccgttcctggaggcagccgcttatgaaatcaccaattccaagtctcccaacaataaagagcagagagaaaaggagcaatcagaggcacttagtctgaacaatttgaaaaacgtgctctttattttcctggaaaagctgcaggtactcaggaattactatagccactacaaatactccgaggaatctcctaagccaatctttgagacatcgttactgaaaaacatgtataaggtgttcgatgccaatgtccggcttgtgaagcgcgactacatgcatcacgaaaacattgatatgcagagagactttactcacttgaacaggaaaaagcaggttggtcggaccaaaaatatcatagattcacccaacttccattatcactttgctgacaaggagggcaatatgacaattgccgggctgctattcttcgtgagcctctttctggataaaaaggacgcgatctggatgcaaaagaaacttaagggattcaaagacggccgcaacctgcgagagcagatgaccaatgaagtcttttgcagaagtaggatttccttgcctaagctcaaactggagaacgtgcagactaaggattggatgcagttagacatgctgaatgaactcgtacggtgtccaaagtctctttacgagcgtctgcgcgaaaaagatagagagagcttcaaggttccctttgacatcttctccgatgactatgatgcagaggaggaaccttttaaaaacacattggtgaggcatcaagaccggttcccatactttgtcctacgatatttcgatctgaatgaaatctttgagcagctccgcttccagattgacctgggtacctaccacttttcaatatacaacaagagaatcggggatgaagacgaggtgaggcaccttacgcatcacctgtatggattcgcccggattcaagacttcgctccgcagaatcagcccgaggaatggcgcaaattggtgaaggatctcgaccattttgagaccagtcaggaaccttacatcagcaagactgccccacactatcatctggagaacgagaaaataggcattaagttctgctctacacacaataacttatttccctccctgaaaagagaaaagacttgtaatggcaggtcaaaattcaacctagggacccaatttacagcagaggctttcctcagcgtccacgaactgcttcctatgatgttttactatttgctgctcaccaaggattacagtcgtaaagagtctgccgacaaggttgaaggaatcatccggaaggagatttccaacatctatgcgatttacgatgccttcgcaaataacgagataaatagcatcgctgacctgacgtgccgacttcagaaaactaacattctgcagggtcatttgccaaagcagatgatctcgatcctcgaaggcagacaaaaagatatggagaaggaagccgagaggaaaattggggaaatgatagacgatacacagcgccggctggacttactgtgtaagcagaccaatcagaagatcagaattggaaaaaggaacgctggcctactcaagtctggtaaaatcgccgattggctggtgtccgacatgatgcgctttcaacccgtacagaaggatactaataacgcaccgattaataactcaaaagccaatagtacagagtaccgaatgcttcagcacgctttggcgctgttcgggagcgagtcctctcggctcaaggcatattttcgtcagatgaacctggtgggaaatgccaaccctcatcccttcttagctgaaacccaatgggagcaccagacgaatatcctgagcttttacagaaactatcttgaagccaggaagaaatacttgaagggcctcaaaccacagaactggaagcaatatcagcacttcctgatactaaaagtccagaagaccaatcgcaacacactggtgactggctggaaaaattcattcaacctccctcgggggatctttacccagcccattagagagtggttcgaaaaacataataacagtaagaggatctacgaccaaattctgtcctttgaccgagttggattcgtggcaaaagccatcccactttattttgctgaggagtacaaggataatgtccagcccttctacgactatccttttaacataggtaataaattgaagccacagaaaggccagttcctggataagaaggaacgcgtggagttatggcaaaagaacaaggaactctttaaaaattacccgagcgagaagaacaaaacagacctggcctatcttgatttcctgtcttggaagaagtttgagcgggaattgagactcattaaaaatcaggacatcgtaacttggctgatgttcaaggagctattcaaaaccacaaccgttgaagggctgaagattggagagatccacctcagggatatagacactaacacggcaaatgaagagtcaaacaacatcctgaatcgtattatgcccatgaaacttcctgtgaagacatacgagaccgataacaagggcaatatcttgaaagaacgcccactggcgactttttatattgaggaaaccgagacaaaggtcttaaaacagggtaacttcaaggtgctcgctaaagaccggagactgaatgggcttctgagttttgccgaaaccactgatatcgacctagagaagaaccccataacaaagctcagcgtcgattacgagctgattaaatatcagacgaccaggatctccatcttcgaaatgactttgggcctggagaagaaattaattgacaagtactctacactccctaccgactcgtttcgaaatatgctggaacggtggcttcaatgcaaagcaaaccgcccagagctgaagaattacgtgaacagcttgatcgccgttagaaatgctttctcccataaccagtatcccatgtacgatgccacactctttgcagaagtgaagaaattcactctgtttccgtcagtagacaccaagaaaattgagctaaatatagctcctcagctgcttgagatcgtcggaaaggccattaaagaaatcgagaagagtgaaaacaaaaattga

SEQ ID NO: 11347 - RNA, 3273 nt, synthetic construct
  misc_feature 1..3273: note = Cas13b variant__Prevotella sp.__WP_044072147.1__Cas13b
  source 1..3273: mol_type = other RNA
atgaacatccccgccctggtggagaatcagaagaaatacttcggcacctatagcgtcatggctatgctcaacgcacaaacagttcttgaccacattcagaaggtggccgatatagaaggggagcagaatgaaaacaatgagaacctgtggtttcatcctgtaatgtcccacttgtacaatgcgaaaaacggatatgacaagcagccagagaaaactatgttcatcattgagagattacaatcttactttccgttcctgaagatcatggctgagaatcagagggaatattcaaacggtaagtacaaacagaatcgggtggaggtcaacagtaatgatatttttgaagtgctaaagcgcgccttcggcgttctcaaaatgtatcgagaccaggcaagccattacaagacgtacgatgagaaactgatcgacgggtgcgagtttcttacctccacagaacaacccctgtctggaatgataaacaattattacactgtggccttgcgtaacatgaacgagagatatggctacaagaccgaagatctcgctttcatccaggacaagaggtttaaattcgtcaaggatgcatatggtaaaaagaaatcacaggtgaatacagggtttttcctgtcgctgcaggactacaacggagatacccaaaagaaactccacttaagcggcgtaggcattgccctgcttatctgtttgtttctggacaagcagtatattaatatcttcctaagtcggctccctatattctcctcttacaacgctcagagcgaggaacgcagaattatcattaggtcctttgggatcaattcaatcaagcaaccaaaagatcggattcatagtgaaaagagcaacaaatctgttgccatggacatgctgaatgagataaagcgctgccccaacgaacttttcgagactctgtccgcggaaaaacagtcacgatttagaatcattagcaatgaccacaacgaggtgttgatgaagaggagttctgatcggttcgtccctctcctgttacagtacatcgactatggaaagctgtttgatcacatacgtttccatgtgaatatgggtaaactccgctaccttctgaaggcagacaaaacatgtattgatggccagaccagagtgagggtcatcgaacaaccattgaacgggtttggacggctagaggaggttgaaacgatgcgaaagcaggagaatggcactttcggtaactccgggatccgcattagagactttgaaaatatgaaaagggatgacgccaaccccgctaactatccttacatcgtggatacctatacacactacattctggagaataacaaggtagaaatgttcataagcgacgaggagactccagccccgctcctgcccgtgatcgaagatgaccggtatgtcgtgaagaccattccttcgtgccgcatgtctacacttgagatcccagcaatggcttttcatatgttcctgtttggatccaaaaagaccgaaaaattgatcgttgacgtgcacaatagatacaagcgtctcttcaaagccatgcagaaggaggaggtcacggcggaaaacattgcctcattcggcatagcagagagtgatctgccccagaagatcattgacttaatcagcggcaatgctcacgggaaagatgtggacgcctttattaggctgactgtagatgacatgctagctgatacagaacggcgaatcaagagattcaaagacgataggaagtccatacgctctgccgacaacaaaatgggaaagcggggttttaaacaaatcagcaccggcaagctcgcagatttcctggccaaggacattgttctttttcagccttcagtgaatgatggggagaacaaaatcactggattgaattacagaattatgcagagtgctatcgcggtctataactccggcgacgactacgaagcaaagcagcaattcaaactgatgtttgagaaggccaggctcataggtaaagggacaaccgagccacatcccttcctgtataaggtgtttgtccgcagcattccggctaatgccgtggatttctacgaacgatatcttatcgagcggaagttttacctgattggcttgtctaacgaaatcaaaaagggaaatcgtgttgacgtgcctttcataagaagggatcagaacaaatggaagacgcccgcaatgaaaaccctcggccgcatctatgacgaggatctgccagtagaattacctcggcagatgtttgacaatgagattaagtcacacctgaagagtctaccccagatggaggggatcgatttcaacaacgccaatgtcacatacctcattgctgaatacatgaaaagagtgctgaacgacgatttccaaactttttatcagtggaagaggaattaccgatatatggacatgcttcgcggagagtacgatcggaaaggtagcttgcagtcctgtttcacctctgttgaagagagagaaggcctgtggaaggagagggcctcgcgtacagagcgctatcggaaactcgcaagcaacaagatcagatccaataggcaaatgcgaaacgcgtcaagtgaagagatagaaactattctggacaagcggttatctaatagccgcaacgagtaccagaaatccgagaaggtgatcagaaggtatcgggtccaggatgctctgctttttctcctcgccaaaaagaccctgacagaactagcagacttcgacggggagcgatttaaactgaaggaaatcatgccagatgccgagaaaggaattttgtcagaaatcatgcccatgagcttcacctttgagaagggcggtaagaaatacactattacgtctgaggggatgaagctgaaaaattacggcgacttctttgtgcttgcttccgataagagaataggaaacttgctggaattagtaggcagtgacacagtgagcaaagaggatatcatggaagagttcaagaagtatgaccagtgccgccctgaaatttcttccatcgtttttaatctcgagaaatgggccttcgatacctacccagagctgtcagcaagggtcgaccgtgaagagaaggtggatttcaaaagtattcttaagatcctgttgaacaataaaaacataaataaggaacaaagcgacatcctccggaagattagaaacgcttttgatcataacaattatccggacaaaggggtggtcgagatcagggccctgcccgaaattgcgatgtcgatcaagaaagccttcggagagtacgctataatgaagtga

SEQ ID NO: 11348 - RNA, 3273 nt, synthetic construct
  misc_feature 1..3273: note = Cas13b variant__Prevotella sp.__WP_042518169.1__Cas13b
  source 1..3273: mol_type = other RNA
atgaacatccccgccctggtggagaatcagaagaaatacttcggcacctatagcgtcatggctatgctcaacgcacaaacagttcttgaccacattcagaaggtggccgatatagaaggggagcagaatgaaaacaatgagaacctgtggtttcatcctgtaatgtcccacttgtacaatgcgaaaaacggatatgacaagcagccagaaaagactatgttcatcattgagagattacaatcttactttccgttcctgaagatcatggctgagaatcagagggaatattcaaacggtaagtacaaacagaatcgggtggaggtcaacagtaatgatatttttgaagtgctaaagcgcgccttcggcgttctcaaaatgtatcgagacctgacgaaccattacaagacctacgaggagaaacttatcgatgggtgcgaatttctgacaagcactgagcagcccttgtccggaatgatatctaagtattacaccgtggcactccgtaatacaaaggaaagatatggctacaaaaccgaggacctggccttcatccaagataacattaagaaaatcactaaggacgcttatggtaaaaggaagtcgcaggtcaacacagggtttttcctgtcactccaggattacaatggagacacccagaaaaagttacacctgagcggcgtgggcattgcacttttgatctgtctgtttctagataagcaatatataaacattttcctcagtcggctgcctatcttttcctcttacaatgcccagagcgaagaacgcagaattatcatcaggtccttcgggattaactcaataaaacttccaaaggaccggatccatagtgagaaaagcaataagtctgtagctatggatatgctgaacgaagttaaacgctgccccgacgagttgttcacgactctctccgccgaaaagcagtcacgatttagaattatcagcgacgatcacaatgaggtgctgatgaagaggagtaccgaccggttcgtccctttactgctccaatacatagattatggaaaactttttgaccacattcgtttccatgtgaacatgggtaagctgcgctacttgctaaaagcggataagacatgtatcgacggccagactagagtgagggtcatcgaacagccactgaatgggtttggacggctcgaggaggcagaaaccatgcgaaaacaggagaacggcacattcggtaattctgggattcgcatcagagattttgaaaacgttaagagggacgatgccaatcccgctaactatccttacattgtggacacctatacgcactacatactggagaataacaaggtagaaatgttcatctccgataaaggaagctcggccccacttctgccgttgattgaggacgaccggtatgtggtcaagactatcccctcttgccgcatgtccacactcgagatccctgcaatggcttttcatatgttcctgtttggcagtaaaaagaccgaaaaattaattgtggatgttcacaacagatacaagaggctgttccaagccatgcagaaggaggaagtgactgcggagaatatagcctcatttggcatcgcagagagcgacctaccacagaaaattctcgatctgatctccgggaacgctcacggaaaggacgtcgatgccttcattcgtcttacagtggacgatatgttgaccgacacggaacggcgaatcaaaagattcaaggatgacaggaaatctatacgcagcgctgataataagatgggtaaacggggctttaagcagatctcaaccgggaagctggccgacttcctcgcaaaagatattgtactgtttcaacccagtgttaacgacggagagaataagatcacaggccttaactacagaattatgcagtccgccatcgctgtgtatgacagcggtgatgactacgaagcgaaacagcagttcaagctgatgtttgagaaagcaaggttgatagggaagggcactaccgaacctcatccattcctctataaggtctttgcccgctctattcccgctaatgccgtggatttctacgagcgatatctgatcgagcggaaattttacttaacaggactgtgtaacgaaattaagcgtggcaatagagtcgacgtgccgttcatcaggcgcgatcaaaacaaatggaagactcctgcaatgaaaaccctagggcggatatattcagaggacctccccgttgaactgccaagacagatgtttgataatgagatcaagagtcaccttaagagcttgcctcagatggaaggaattgacttcaacaatgccaacgtgacatacctgatcgctgagtacatgaaaagggtactcaatgatgactttcagaccttctatcaatggaagcgaaactaccattatatggatatgctgaaaggtgagtacgaccgcaagggctccttacagcactgcttcacttctgtcgaggagcgggaagggctgtggaaagagagagcctcgaggacggaacgttatcgcaaacttgcaagcaacaagattcggtccaatagacagatgaggaacgcgtcaagtgaggagatcgaaacaatattggataaacgactctctaattgtcggaacgagtaccaaaagagcgaaaaagtgattcgcagatatagggttcaggacgctctgctatttctgctcgccaagaaaaccctgactgagcttgcagacttcgatggagagcggtttaagttgaaagaaatcatgcccgacgccgagaagggcatcctgtccgaaattatgccaatgtcattcacctttgagaagggtgggaaaaagtacacaatcaccagcgaaggcatgaaattaaagaattacggagatttctttgtgctcgcttctgacaaacgaattggcaacctgcttgagctggtcgggtccgatatagtgagtaaggaggacatcatggaagagttcaataagtatgatcagtgcagacccgaaattagctctatcgtatttaacttggagaaatgggccttcgacacttaccctgaactctccgcacgcgtggatagggaggagaaggttgactttaaatcaattctgaagatcctactgaataacaaaaatataaacaaggaacagagtgatatcctccgtaagattcggaatgctttcgaccataacaattatccagacaaaggaatcgtcgagattaaggccctgccggaaatcgcgatgagcattaaaaaggccttcggtgagtacgctataatgaaatga

SEQ ID NO: 11349 - RNA, 3273 nt, synthetic construct
  misc_feature 1..3273: note = Cas13b variant__Prevotella sp.__WP_044074780.1__Cas13b
  source 1..3273: mol_type = other RNA
atgaacatccccgccctggtggagaatcagaagaaatacttcggcacctatagcgtcatggctatgctcaacgcacaaacagttcttgaccacattcagaaggtggccgatatagaaggggagcagaatgaaaacaatgagaacctgtggtttcatcctgtaatgtcccacttgtacaatgcgaaaaacggatatgacaagcagccagaaaagactatgttcatcattgagagattacaatcttactttccgttcctgaagatcatggctgagaatcagagggaatattcaaacggtaagtacaaacagaatcgggtggaggtcaacagtaatgatatttttgaagtgctaaagcgcgccttcggcgttctcaaaatgtatcgagacctgacgaaccattacaagacctacgaggagaaacttatcgatgggtgcgaatttctgacaagcactgagcagcccttctccggaatgatatctaagtattacaccgtggcattgcgtaatacaaaggaaagatatggctacaaagccgaggacctcgcttttatccaagataacaggtataagttcaccaaagacgcatacggtaagcggaaatcgcaggtcaacactgggtcatttctgagcctgcaggattataatggagacacaaccaagaaactccacttaagtggcgtgggcattgccctgcttatctgtttgttcctggataagcagtacattaacctatttctctcccgcctgcctatcttctctagctacaatgctcaatccgaagagagaaggataattatccggtcattcgggattaacagtatcaagcagccaaaagaccgcatccatagcgagaagtctaataaatccgtagccatggatatgcttaacgaagttaagcgatgccccgacgagctgtttacgactttgtcagcggaaaaacagagcagattcaggattataagtgacgatcacaatgaggtgctcatgaagcggtcttccgaccgttttgtccctctgttactgcaatatatcgattacggaaagctctttgaccacattcgctttcatgtgaacatgggtaaacttagatatctgttgaaggcagataaaacctgtatcgacggccagacaagggtgcgggtcatagaacagccactaaatgggttcggacgactggaggaggttgaaactatgcgcaagcaggagaacggcacctttggtaatagcgggattagaatcagggatttcgaaaacatgaaacgggacgatgccaatcccgctaactacccttatatcgtggagacatacacccactatattctcgaaaataacaaggtagagatgtttatctcggacgaggaaaacccaacgccgctgcttcccgtgattgaggatgaccgctacgtcgtgaagactataccttcttgcagaatgtccacactggaaatcccagccatggcattccatatgtttttgttcggatcagagaaaaccgagaagctcattatcgacgttcacgataggtacaaacgtctgtttcaagctatgcagaaggaagaggtgactgccgaaaatatcgcgagtttcggcattgccgagagcgacttaccccagaaaataatggatctgatctccggcaacgcacacgggaaggacgtcgatgctttcattcggctaacagtggacgatatgctcaccgacacggaacgaagaatcaagaggtttaaagatgaccgcaagtctattcggagcgccgataataaaatgggaaagagaggtttcaaacagatctcaaccggcaagctggctgactttcttgccaaagatatagtattgttccaacctagtgttaacgacggggagaataagatcacaggactgaactataggattatgcagtccgcaatcgccgtgtacgacagcggcgatgactatgaggctaagcagcagtttaaactcatgttcgaaaaggcgcgcctgattggtaaagggactaccgagccacatccctttctttacaaggtcttcgtgcgatctatcccggcaaatgccgtcgatttttatgaacggtacctgatagagcgtaaattctatttgattggcctctcaaacgaaatcaagaagggaaatagagtggacgttccttttattaggcgcgatcaaaacaaatggaagacacccgctatgaaaactctgggccggatctacagtgaggacttaccagtggagctgcctagacagatgttcgataatgaaataaagagccacctaaaatccctcccccagatggaggggatcgactttaacaatgccaacgtaacctacctgattgcagaatatatgaagagggtccttaatgatgacttccagacattctaccaatggaagcgaaactatcgctacatggatatgttgcggggagagtatgacagaaaaggttctctgcagcattgttttacctcgatcgaagagagggagggcctctggaaggaacgtgccagccgcactgagcggtacagaaaactggcttccaacaagattaggtcaaatcgacagatgcggaacgccagttctgaagagatcgagacgatattagataaacgcctgagcaattgcagaaacgaatatcaaaagtccgagaagattatcaggcggtaccgagtgcaggacgcacttttgttcctcctggcgaaaaagacactaaccgaactggctgactttgatggggagagattcaaactcaaggaaatcatgccagacgccgagaaaggaatactgtcagagatcatgcccatgagctttactttcgaaaagggcggtaaaatttacaccataacatctgggggcatgaaacttaagaattatggagatttcttcgttttggcatccgacaaacgcatcggcaacctgttagagctcgtggggagtaataccgtcagcaaggaagatattatggaggaatttaaaaagtacgaccagtgtaggcctgagatctcttccattgtgttcaacctggagaaatgggcctttgatacttatccagaacttccggctcgtgtagaccggaaggagaaggtggatttctggtcaatcctggacgttttgagtaataacaaagatataaataacgaacagagctacatcctcagaaagattaggaatgccttcgaccacaacaattatcccgacaaaggaatcgtcgagattaaggcactgcctgaaatcgctatgtcgattaaaaaggcctttggtgagtacgcgattatgaagtga

SEQ ID NO: 11350 - RNA, 3438 nt, synthetic construct
  misc_feature 1..3438: note = Cas13b variant__Psychroflexus torquis__WP_015024765.1__Cas13b
  source 1..3438: mol_type = other RNA
atggagagcatcattggcctggggctctccttcaacccctacaagaccgccgacaaacactattttggatctttccttaatctggtggaaaacaatttgaacgctgtctttgcagagttcaaggaaagaatatcatacaaagccaaggatgagaatatcagtagcttaattgaaaaacattttatcgacaacatgtccattgttgattatgagaagaagatctctatactgaatggttacctacctatcattgacttcctcgatgacgagctggaaaacaatcttaacacaagggtgaaaaattttaagaaaaacttcatcattctggcggaggctatcgaaaagttgcgggattattacactcacttttatcatgacccaataacgttcgaggataataaagagccgctcctggaactgctcgacgaggtattactgaagaccattcttgatgtgaagaaaaagtacttgaaaacagacaagactaaagaaatcctgaaggattcgctacgcgaggaaatggacctcctggtcattcgaaaaaccgacgagcttcgtgagaagaagaaaacaaaccccaagatccagcacaccgattcaagccaaatcaaaaatagtatttttaacgacgccttccagggcctgttgtacgaagataaggggaacaataaaaagactcaggtgtcccatagagcaaagacaaggctcaaccctaaagacatacacaagcaggaggaacgggattttgagatcccactgtctaccagcggattagttttcctgatgtccctcttcctttcaaagaaggaaattgaggactttaaaagtaatatcaagggcttcaagggtaaagtggtcaaggatgagaaccacaatagcctgaaatatatggccacgcatcgcgtgtactctatattggcttttaaggggctaaaatatagaattaagactgacaccttctccaaggaaacactgatgatgcaaatgatcgatgagctctcaaaagtacccgactgcgtttaccagaacctgagcgaaactaagcagaaagattttatcgaggactggaatgaatatttcaaggacaacgaggagaataccgaaaaccttgagaatagtagggtggtccaccctgtgattcggaaacgctacgaagataagtttaactatttcgcaatccgatttctggacgagttcgccaattttaaaacattgaagttccaggtgtttatgggatactacattcatgatcaaagaaccaagacgataggcactacaaacatcaccactgagaggacagtcaaagaaaagattaatgttttcggcaaactctctaagatggacaacctgaaaaagcacttcttttcccagttaagcgatgacgagaacaccgattgggagttctttccaaatccctcgtataacttcctgacgcaggctgacaattctcctgccaacaatatcccaatctacctagaactcaagaaccagcaaattataaaagaaaaggatgcgatcaaagcagaggtgaatcagacccagaaccggaatccgaacaagccctccaaacgtgacctgcttaataagattttgaagacatatgaggattttcaccaaggggaccctactgccatcctgtcactcaacgaaattccagctctgcttcatctgttcttggtaaaacccaataacaagaccggacagcagatcgagaatataatccgcattaaaatcgaaaagcagtttaaagccattaaccaccctagtaagaacaataagggtatcccaaaaagcctcttcgcagatacaaacgtgagagtcaatgctataaagctgaaaaaggacttagaggccgaactggacatgctaaacaaaaagcatattgcgtttaaagagaatcaaaaggcctcctctaactacgataagctcctgaaagagcaccagttcactcccaagaataaaaggccggaacttcggaagtatgtgttttacaaaagcgagaagggcgaagaggcaacctggttggctaacgacatcaagcgattcatgcctaaagattttaagacaaaatggaaggggtgtcagcattcagaactgcagcgcaaactcgccttctatgacagacacaccaagcaagatattaaggagctgttaagtggatgcgagttcgaccactccctgcttgatatcaatgcttactttcagaaagacaacttcgaagactttttcagcaagtacttggagaataggatagaaactctcgagggcgttctgaaaaagctacatgattttaaaaacgagcccacgccactgaagggtgtgttcaagaattgttttaaattcctcaagcggcagaactatgtcacagaatctcctgagatcattaaaaagcgcatcctggccaaacccacctttcttccaagaggggtgttcgatgaaaggcccactatgaagaagggcaaaaatcctttgaaggacaaaaacgagtttgcagaatggttcgtagagtacctggagaacaaggattatcagaaattctacaatgccgaagagtatcgtatgcgggacgctgactttaagaaaaacgcggttattaagaagcaaaaattaaaggatttctacaccctccagatggtgaattatctgcttaaagaagtctttggaaaggacgagatgaacctgcagttgtcagaactcttccagacacgacaagagagactgaaactacagggcatcgcaaagaagcagatgaataaagagaccggggatagtagcgaaaacactaggaatcaaacatacatatggaacaaggacgtgccagtctcctttttcaatggaaaagtgacgattgataaggttaaactgaagaacatcggtaagtacaaacgctatgagcgggacgaaagagtgaagacctttatcggctacgaggtagatgaaaaatggatgatgtatctcccgcacaattggaaggacaggtactctgtcaaacccattaacgtgatcgatctgcagattcaggagtatgaggaaatacgctcgcatgagcttttgaaggaaatccagaatctggagcaatacatttatgaccacactacagataagaacatcttactccaggacgggaatcctaacttcaaaatgtacgttctgaatggacttctgattggcatcaaacaggtgaacataccagactttatcgtcctaaaacagaacaccaatttcgataagattgactttacaggtatcgccagctgctccgagctcgagaaaaagactattatcctgatagctattcgaaacaaattcgcccacaatcaattgcccaacaagatgatctacgatctggcaaatgaatttttaaagatcgagaaaaacgaaacctatgccaattactatctcaaggtgctgaaaaagatgatttcagaccttgcttga

SEQ ID NO: 11351 - RNA, 2847 nt, synthetic construct
  misc_feature 1..2847: note = Cas13b variant__Riemerella anatipestifer__WP_049354263.1__Cas13b
  source 1..2847: mol_type = other RNA
atgttctttagcttccacaacgcccagagagtgatctttaagcatctgtacaaggctttcgacgcatccctcaggatggtcaaggaggattataaagcccactttaccgttaatcttacacgggacttcgcgcatctgaaccgcaagggcaaaaataagcaagataaccccgactttaatcgataccgtttcgaaaaggatgggtttttcactgagtctggattgttatttttcacgaacctgtttctagacaaaagagatgcttattggatgctcaagaaagtgtcaggtttcaaggccagtcacaaacagagggaaaagatgaccacagaggtattctgccggagccgcattctgcttcctaagctgagattggaatccaggtacgaccataatcagatgctcctggatatgctgtctgagctctcgcggtgtccaaaattactgtatgagaaactttcagaagagaacaaaaagcactttcaggtggaagcagacggcttcttggatgagatagaggaagaacaaaatccgtttaaagacactctgatccgccaccaggatcgattcccctactttgccctaagatatctcgacctgaacgagagcttcaagagtattaggtttcaggtcgaccttgggacctaccattactgcatctatgataaaaagattggagacgagcaggaaaagcggcacctgacacgtaccttgctctccttcggccgcctgcaagattttactgagatcaatagacctcaggagtggaaagctctgacaaaggacctggattacaaagaaacctctaaccagccattcataagcaagacgactccccattatcacatcaccgacaataaaattggttttaggctcgggacatccaaggagctttacccttcactggaaatcaaggatggagcaaaccggattgccaaatatccatacaatagtggcttcgtggctcacgcctttatcagcgttcatgagttgctacccctgatgttctatcagcacctcactggcaagtctgaagacctgcttaaagagaccgtgcgacatatacaacgcatttacaaggatttcgaggaagagagaatcaacacaattgaagacctggagaaagcgaaccaggggaggttgcctctcggagcatttccaaagcagatgctgggtttactgcaaaataagcagccggatctatccgaaaaagccaagatcaaaatcgagaagctcattgctgagaccaaactgctttcacaccggttgaacacgaagttaaagagcagtcccaaactcggcaagcgcagagaaaaactgataaagactggggtccttgccgactggctggtgaaagacttcatgaggtttcagcctgtagcatacgatgctcagaatcaaccaatcaagtcttccaaagccaacagcacagagttctggtttattcgtcgggcgttggccctctatggaggcgaaaagaatcgactggagggttacttcaagcagaccaacttaatcgggaatactaacccccatccttttctgaataaattcaactggaaggcatgtagaaatctagttgacttttatcagcagtacctcgagcaaagggaaaaattcctggaggctataaagaaccagccatgggaaccctatcagtactgccttttgctgaaaattccgaaggagaatcgcaagaacctcgtgaaaggatgggaacagggcggcatctcgctgcctcgggggttatttacagaggccatcagagagaccctgtctgaagatcttatgttgtccaagcccattaggaaagagatcaagaaacacggacgcgtcggtttcatttcacgagctataacgctctattttaaggaaaagtaccaagacaaacaccagagtttctacaatctgagctataagctagaggccaaagcaccactgctcaagcgggaggaacattacgagtattggcagcagaacaaacctcaatcccccaccgaatctcagcgtctggagcttcacacaagcgatagatggaaggactacttgctgtataagaggtggcagcatttagaaaagaagctccgcctgtaccggaaccaagatgtgatgctttggctgatgactttggagctcaccaaaaatcacttcaaggaactgaacctaaattatcaccagctgaaactcgagaacctggccgtgaatgtccaggaggctgacgcgaaacttaacccattgaatcagacactgcccatggttttacctgtgaaagtatacccagcaactgcctttggcgaagtgcaataccataagaccccgatcagaacagtctatattagggaggaacacaccaaggctctcaaaatggggaacttcaaggccctggtgaaagatcgacgccttaatggactgttttcattcatcaaggaggagaacgacactcagaaacatcccatcagtcagctacggctcagaagggaactggagatttaccagtccttgcgtgttgatgcatttaaggaaacgctgagcttagaggaaaagctcctgaataaacacacatctctttcaagtctggagaacgagttccgcgccttgctcgaagagtggaagaaagaatatgctgccagctccatggtgaccgacgagcatatagcatttatcgcgtctgtccggaatgctttctgtcacaaccaataccctttttataaggaagccctgcacgcaccaattcccctattcactgtggcccagcctaccacagaggagaaagatggcctgggtatcgctgaagcccttctcaaggtactgagagagtactgcgaaattgttaagtcgcagatctga

SEQ ID NO: 11352 - RNA, 3288 nt, synthetic construct
  misc_feature 1..3288: note = Cas13b variant__Riemerella anatipestifer__WP_004919755.1__Cas13b
  source 1..3288: mol_type = other RNA
atggagaagcccctgctccctaacgtgtacacccttaaacacaagttcttttggggcgccttcctgaatatcgctagacataacgcatttattacaatatgccacatcaatgaacagttggggttaaaaactccaagcaacgacgataagattgtcgacgttgtgtgtgagacgtggaataacatcctgaataacgatcatgacctactcaaaaagtcccaactgaccgaacttattctgaagcacttcccgtttttgacagccatgtgctatcatccccctaaaaaggagggaaagaagaaaggtcaccagaaggaacagcagaaggagaaagagtctgaagcgcaatcacaggctgaggccctcaatccaagtaagctgatcgaagcactggagatactcgtaaaccagttacacagcctgaggaattactattcccattacaaacacaagaaacccgatgccgagaaggacatcttcaaacatctttataaggcttttgatgcatctttgcggatggtgaaggaagactacaaagcccacttcactgtcaacctgacccgcgattttgctcacctaaatcgaaagggcaaaaacaagcaggacaatcctgatttcaaccgttatagatttgagaaagacgggttctttacagaatcgggactcctgttcttcaccaacctttttctggataagagggacgcctactggatgttgaagaaagtgtcaggcttcaaggcgagccataaacaacgggagaagatgactacagaagttttctgtcgcagtaggattctcctgccaaaattaagactggagtcccggtacgaccacaatcagatgctccttgatatgctgtctgagttgagccgctgccccaagctactgtatgaaaagctctccgaggaaaacaaaaagcatttccaggtggaggcagacggttttctggatgaaatcgaggaggaacagaatcctttcaaagacacccttattcgacaccaagatagatttccatacttcgccctgaggtatttggacctcaacgagtcatttaagagtatccggttccaggtcgatctggggacgtaccattattgtatatacgacaaaaagattggagatgaacaggagaagcgtcacttaactcgcaccctgcttagctttggcagactccaagacttcacagaaatcaataggccgcaggagtggaaagctctgactaaggatcttgactataaagagacctctaaccagccctttatttccaagacaacccctcactaccatatcacggacaataaaatcggcttccggttggggacttcaaaggaactgtacccaagcctcgagattaaagatggagccaaccgaatagcaaagtatccctacaatagtggtttcgtggctcacgcctttatctctgtacatgaactgcttcctctgatgttctatcagcacttgacaggcaagtccgaggacctcctgaaagagaccgttcgccacattcaaagaatctacaaggattttgaagaggaaaggataaacactattgaggacttagaaaaagcgaatcaggggcggctgccactaggagccttccccaagcagatgctcggcctgcttcagaacaaacaaccggatttgagcgagaaggcaaagatcaaaatcgagaagctgattgctgaaacaaaactcctgtcgcatcgcttaaataccaagctgaaatcttcccctaagctaggtaagagaagggagaaattgatcaagacgggggtgctcgccgactggctggtcaaagattttatgcgtttccagcccgtggcttatgacgcccagaaccagccaattaagtcaagtaaagcaaatagcaccgaattttggttcatacggcgagccctagctctgtacggaggcgagaagaacagactcgaaggctattttaagcaaacaaacctgatcgggaatactaaccctcaccccttccttaataaatttaactggaaggcgtgcaggaatttggtggatttctaccagcagtacctggagcagcgcgagaaatttttagaagcaattaagaaccaaccatgggagccctatcagtactgtctcctgcttaaaatccctaaggaaaatcggaaaaacctggtcaagggatgggagcagggtggcatctccttgccaagagggctctttaccgaagccattagggagacactgtctgaggacctaatgctgagcaagccgatacgcaaagaaatcaagaaacatggacgagttggcttcatttcacgggctatcactctctattttaaggagaaataccaagataagcaccagagtttctataatctgtcctacaaacttgaagccaaagcacccttgctgaagcgtgaggagcattatgaatactggcagcagaacaaacctcaaagcccaaccgagtctcagagattagaactccacacatcagacaggtggaaggattacctgctttataaacgctggcagcacctggagaagaagctacggctctacagaaatcaggacgtgatgctgtggttgatgaccctggaattaactaaaaaccattttaaggagctcaatctgaactatcaccaacttaaactggagaatttggccgtaaacgtgcaggaagctgacgccaagctcaaccccctgaatcagacgctacctatggtcctgccagtgaaagtttaccccgcaacagcgttcggtgaggtgcagtatcataagaccccgattaggactgtctacatccgagaggaacacaccaaggctcttaaaatggggaactttaaggccctcgtgaaagatcgccggctgaatggcttgttcagttttataaaggaagagaacgacacacaaaaacatcctatcagccagctgagattaaggcgtgagctcgaaatttatcagtccctgcgcgtagatgcattcaaggagaccctttctctggaagagaagttgctcaataaacacacttcgctgagctccctagaaaacgagtttcgggccctgcttgaggaatggaagaaagagtacgctgcctcaagtatggttacagacgaacacatcgcattcattgcttctgtgagaaatgccttttgccataaccaatacccattctataaggaggcgctccacgcccccatccctctgttcacggtcgctcagcccaccactgaggaaaaagatggattgggcatagcagaggccttactgaaggtgctcagggaatactgtgagattgtcaaaagccagatctga

SEQ ID NO: 11353 - RNA, 3288 nt, synthetic construct
  misc_feature 1..3288: note = Cas13b variant__Riemerella anatipestifer__WP_064970887.1__Cas13b
  source 1..3288: mol_type = other RNA
atggagaagcccctgcctccaaacgtgtacaccctcaaacacaagttcttttggggcgccttccttaatatcgctagacataacgcatttattacaatatgccacatcaatgaacagctggggttgactacgccgcccaacgacgataaaattgccgacgtcgtttgtggaacctggaataacatcttaaataacgatcatgacctgctaaagaaaagccaactcacagagctgattcttaagcacttcccttttctggcggctatgtgctatcatccacccaagaaagaaggtaagaaaaagggctcccagaaagagcagcagaaggaaaaggagaatgaggcccaatctcaggcagaagccttgaacccttcagagctcatcaaagtgctgaagactctggtaaaacagctcaggaccttacggaattactatagtcaccacagccataagaaaccagatgctgaaaaggacatattcaaacacctgtacaaggcatttgatgcctcccttcgcatggtgaaggaggactataaagctcatttcacagtcaacttgacccaggattttgcccacctgaatcgaaaggggaaaaacaagcaagacaatcccgatttcgaccgttacagatttgagaaagatggattctttactgaatctggcctactcttcttcacaaacctgtttcttgacaagagggacgcgtattggatgctgaagaaagtgtcgggtttcaaggcatcacacaaacagagcgagaagatgaccacggaagtgttttgtcggagtcgcatcttgctccctaaactgagattagagtccaggtacgatcataaccagatgctgctcgacatgctttctgaactgagccggtacccaaagttgctatatgagaagctgtccgaggaagataaaaagcgcttccaggttgaggccgacgggtttctcgatgaaattgaggaagaacaaaatccgttcaaagacactctgatccgacaccaggatagatttccctacttcgctcttaggtatctggacttgaacgagtcatttaagagtattcggttccaggtcgatctcggaacctaccattattgcatctacgacaaaaagataggcgatgaacaagagaagcgtcacctgacacgcactttactgagctttggcagactacaggacttcaccgaaattaataggcctcaggagtggaaagccctcacaaaggacctggattataaagaaacctctaagcagccatttatctccaaaacgactccccattaccacattacagacaacaagatcgggttccggcttggaacctcaaaagagttgtaccctagcctggaggtgaaggatggtgcaaatcgaatcgctcaatatccatacaacagtgacttcgtagcccacgcgtttatttctgttcatgaactcctgccccttatgttctatcagcacctgactggcaagtccgaggatttgctcaaagaaacagtgcgccatatacagagaatctacaaggactttgaggaggaaaggattaataccatcgaggatctggaaaaagccaaccaggggcggttaccgctgggagcattccctaagcaaatgctaggcctcctgcagaataaacagcccgaccttagcgagaaggctaagataaaaattgaaaagttgatcgccgagacgaaactgctctcgcaccgcctgaacaccaagttaaaatcttccccaaagctgggtaagagaagggagaaacttatcaagacaggggtcttggctgattggctcgtgaaagactttatgcgtttccagcctgtggcctatgatgcacaaaatcagcccattgaatcaagtaaggccaacagcactgagtttcagctgatccagcgggctctagcgctgtacggaggcgagaaaaatcgactcgagggctatttcaagcaaaccaacctgattgggaatacaaacccacacccctttcttaacaagttcaattggaaagcatgtagaaacttggtcgacttttaccagcagtacctggaacaaagggagaagttcttagaggccatcaaaaatcagccttgggaaccatatcagtactgcctcctgcttaagataccgaaagagaaccgcaagaatctggttaaaggatgggaacagggtggcatttccttgccccgggggctctttactgaggctatcagagaaaccctgtctaaggatctaacactgagcaagcctatcaggaaagagattaagaaacatggacgcgtgggcttcatatcacgagccatcaccctctatttccgggagaagtaccaagacgaccaccagagtttttatgatctgccatacaaacttgaagcaaaggcctcccccttgcctaagaaagagcattatgaatactggcagcagaacaagccacaaagccccactgagctgcagcgtttagagctccacacgtctgacagatggaaagattacctgctttataagaggtggcagcatctggagaaaaagctacgcctctaccggaatcaggacgtaatgctgtggttgatgacactggaattaaccaagaaccacttcaaagaactcaatctgaactatcaccaacttaagctggagaatttggctgtgaacgtccaggaagccgatgcaaaactcaatccgctgaaccagactctacctatggtgctgccagttaaggtgtaccccgcgaccgcttttggtgaggtccaatatcaggagacacctattagaaccgtgtacatcagggaggaacagactaaagcccttaagatggggaatttcaaggcactcgtaaaagaccgacgcctgaacggcttgttttcattcattaaggaagagaacgatacacagaaacatcccatcagtcaactgcggttaagaagggaactcgagatatatcagagcctgcgtgttgacgcctttaaggagacgcttaatctggaagagaaattgctcaagaagcacacctccctgtcttcggtggaaaacaaattccgcatcctactggaggaatggaagaaagagtacgctgccagctccatggtcactgatgagcatattgcatttatcgcttcagtgcggaatgccttctgtcacaaccagtacccattttatgaagaggcgcttcatgcccctattcccctcttcacagtcgctcagcaaaccacagaagagaaggacggactgggcatcgcagaggccttgttaagagtgctgagggaatactgcgagatagttaaaagtcagatttga

SEQ ID NO: 11354 - RNA, 2853 nt, synthetic construct
  misc_feature 1..2853: note = Cas13b variant__Riemerella anatipestifer__WP_061710138.1__Cas13b
  source 1..2853: mol_type = other RNA
atgttctttagcttccacaacgcccagagagtgatctttaagcatctgtacaaggctttcgacgcatccctcaggatggtcaaggaggattataaagcccactttaccgttaatcttacacgggacttcgcgcatctgaaccgcaagggcaaaaataagcaagataaccccgactttaatcgataccgtttcgaaaaggatgggtttttcactgagtctggattgttatttttcacgaacctgtttctagacaaaagagatgcttattggatgctcaagaaagtgtcaggtttcaaggccagtcacaaacagagcgaaaagatgaccacagaggtattctgcaggtcccggattctgcttcctaagctgcgcttggaatctagatacgaccataatcagatgctcctggatatgctgtcggagctctcaaggtgtccaaaattactgtatgagaaacttagcgaaaaagacaagaaatgctttcaggtggaggcagatggcttcttggacgaaatagaggaggaacaaaacccgtttaaggatactctgatccggcaccaggaccgcttcccctactttgccctacgatatctcgacctgaatgagagtttcaaatccattagatttcaggtcgatcttgggacctaccactactgtatctatgacaagaagattggatacgaacaggagaaaaggcatctgacacggaccttgctcaacttcggccgtctgcaagattttactgaaatcaatcgccctcaggagtggaaggctttaacaaaagacctggattataacgagacctctaatcagccattcataagcaagacgactccccactaccatatcaccgacaacaaaattggttttagactcaggacatccaaggaactttatccttcactggaggtgaaggatggggcaaatcggatcgccaaatacccatataacagtgacttcgttgctcacgcctttattagcatctctgtgcacgaattgctacccctgatgttctaccagcatctcactggaaagtccgaggatctgcttaaagaaaccgtccgacacatacaacgcatttacaaggacttcgaggaggaaagaatcaacacaattgaggatctggaaaaagcgaatcagggcaggttgcctctcggcgcatttccaaagcagatgctggggttactgcaaaacaagcagccggacctatcagagaaagccaagatcaaaatcgaaaagctcattgctgagaccaaactgcttagccatcggttgaatacgaagctgaagagttctcccaaactcggaaagcgcagagagaaactgataaagactggtgtgcttgccgactggctggtaaaagatttcatgaggtttcagcctgttgtgtatgacgcacagaaccaaccaatcaagtccagcaaagctaattcgacagaatctcgtttgattcggcgagccctcgcgctgtacggcggggagaagaacagattagaaggatatttcaagcagaccaatctgatcggcaacactaatccccacccttttctaaacaaattcaattggaaggcctgcaggaacctcgtcgatttttaccagcagtatctggagcaacgcgagaaattccttgaagcaataaagcatcagccatgggagccctaccagtattgtttgctgctcaaagtgccgaaggaaaatcggaagaacctggtgaaaggttgggagcaagggggaatttccttacctagaggcctgtttacagaagctatcagggagaccctttcaaaggacttgacgctcagtaaacccatccgcaaggagattaaaaagcacggccgagtcgggttcatcagccgggccattaccctgtactttaaggaaaaataccaggataagcaccagtccttctataatctatcttacaaactggaggctaaggccccactcctgaaaaaggaagaacattatgaatactggcagcagaacaagcctcaaagccccacagagtcacagcgtcttgagttgcacacaagtgacagatggaaagattatctgttatacaagaggtggcagcatctcgagaaaaagctgcgcctttatcggaaccaagacataatgctgtggttgatgaccctcgagctgactaaaaatcactttaaggaactaaacctgaattaccaccagctcaaactggagaaccttgcagttaatgtgcaggaagccgatgctaagttgaacccactgaatcagactttacccatggtactccctgtgaaggtctacccaaccacagcgttcggagaggtgcaatatcatgagaccccgatcagaactgtttacattagggaggaacagacgaaagcactgaagatgggtaacttcaaagcccttgtgaaggaccgacacctgaatggcctattttccttcatcaaagaagagaacgatacacagaagcatcccatcagccagctccgcctgcggagagagttggaaatttatcaatctctgagggtcgacgcttttaaggagaccttatcactcgaagagaaactgcttaataagcacgccagtctgagctccttggaaaacgagttccgtactctcctggaggaatggaaaaagaaatacgcagcctcttcgatggtgaccgataagcatatagcttttatcgccagcgtacgcaatgcattctgccacaaccagtatcctttttacaaggagacactacacgcgccaattctgcttttcaccgttgctcagcccactacagaagagaaagacgggctcggaatcgccgaagcactgttgcgggtgctgagagagtattgtgagattgtcaagtcccagatctga

SEQ ID NO: 11355 - RNA, 2850 nt, synthetic construct
  misc_feature 1..2850: note = ARMAN Cas9 variant__Candidatus Micrarchaeum acidiphilum__OJI07263.1__Cas9
  source 1..2850: mol_type = other RNA
atgagagacagcatcaccgcccccaggtactcctctgctctggcagcccggattaaggagttcaactcagcgtttaaactcggcatagatcttgggacaaagactggaggtgtggctctggtcaaagacaataaggttttgttagccaaaacgttcctggattatcacaagcagaccctagaagaacgccgaatccatcgtagaaacaggcggagtcgcctcgcaagaaggaagcggattgcccgcctgcgaagctggatccttagacaaaagatttacggcaagcagctgcctgacccatataaaatcaagaaaatgcagttgccgaatggggtgaggaagggagaaaactggatagatctcgtagtgtccggccgggacctgtctcccgaggcttttgtccgtgcaatcacactgattttccagaagcgcggtcaaagatacgaagaggtggccaaagagatcgaagagatgtcgtataaggaattttcaactcacattaaagctctcaccagcgttacagaggaggagttcaccgccttagcggcagagatcgaaaggcggcaggatgtggtcgacactgataaggaggccgaacgatacacacagctgagtgagcttttgtccaaagtgtctgagagcaagtccgaatcaaaagaccgcgctcagagaaaggaggatctggggaaggtagttaatgccttttgcagtgcacataggatagaagacaaagataagtggtgtaaagagctaatgaagctcctggaccggcctgtgcgccacgctagattccttaacaaagtcctgattaggtgcaatatctgtgaccgtgccaccccaaagaaaagccggcccgatgtgcgagaattgctctattttgacacggtgagaaacttcctgaaagcgggaagggtcgagcaaaatcctgatgttatttcttactacaagaaaatctatatggacgccgaggtgatccgcgtaaagattttaaacaaagaaaagctgactgatgaggacaagaaacagaagcggaaactcgcatccgaacttaatagatacaagaacaaagagtatgtgaccgatgctcagaagaagatgcaggaacaactgaaaacattgctatttatgaagctgactggcaggtcacgctactgcatggcccatctcaaagagcgagctgccggcaaggacgtcgaggaagggctgcacggagtggttcagaaacggcacgatcgtaatatagcacagagaaaccatgaccttagggtgatcaatctgattgagagcctcttgttcgatcaaaacaagagtctgtctgacgccatccgcaaaaacggtttaatgtatgtcaccatagaagctccagagcccaagacaaagcacgcgaaaaagggcgcagccgtggtacgggaccctagaaaactgaaggagaaactatttgatgaccagaatggggtttgtatttacaccggactccagctggataaacttgaaatctccaagtatgagaaagaccatatcttcccagatagcagggacggcccgtcgattcgagataacttggtgctgacgactaaggaaatcaattctgacaaaggtgatcgcacaccctgggagtggatgcacgacaaccctgaaaagtggaaggctttcgagcggagagtcgccgagttttacaagaaggggaggattaatgaacgtaaacgcgagctcctgcttaacaagggaaccgaatacccaggcgataatcccactgagctggcacggggcggggccagagtgaacaatttcataacagaatttaacgacaggttgaaaacccacggagtccaggagctccaaacgatcttcgagcgaaataagcctattgtgcaggttgtgcggggtgaagagacccagcgcctgagaaggcagtggaacgctttaaatcaaaactttatcccactgaaagatcgggccatgtccttcaatcatgcagaagacgcggctatcgccgcatcaatgcccccgaagttttggcgagagcagatttatagaacagcctggcacttcggccctagtgggaacgaacgccccgactttgctctagccgagctcgcaccacagtggaacgatttctttatgactaagggaggccctataatcgctgtactgggtaaaaccaagtacagctggaaacattccattatcgacgatacaatttataagcccttctctaaaagcgcctactatgtcgggatctacaagaaaccaaatgcgataacttcaaacgccatcaaggtgcttaggcccaagttgctgaatggcgagcacaccatgagtaaaaacgctaagtattaccatcagaaaattggaaatgaacgttttctcatgaagtcccaaaaaggcgggagcatcattacagttaagcctcacgacggaccagagaaggtgctgcagatctctccgacctacgaatgcgcagtcttaactaaacacgatggtaagataattgtgaaattcaagcccatcaaacctctgcgggacatgtatgccagaggcgtaattaaggctatggataaggagcttgagacgtcattgagtagcatgtccaaacatgccaagtacaaagaactccacacacatgacatcatatatctgccagcaaccaagaaacacgtggatgggtacttcatcattactaagctatctgcgaagcacggaatcaaagccctgcccgagtcgatggttaaggtcaaatatacccagattggcagcgaaaacaattccgaggtgaagctcacaaaacctaagccagaaatcaccctggactcagaggatataactaacatttacaattttacaaggtga

SEQ ID NO: 11356 - RNA, 2904 nt, synthetic construct
  misc_feature 1..2904: note = ARMAN Cas9 variant__Candidatus Parvarchaeum acidiphilum__APG80630.1__Cas9
  source 1..2904: mol_type = other RNA
atgctgggcagctccagatacctcaggtataaccttacctctttcgaggggaaggaaccctttctgatcatgggatactataaagagtacaataaggaattgtcaagtaaagcccagaaggagttcaacgaccaaattagcgaatttaattcctattacaaattaggtatagatctgggcgacaagacagggatcgctattgtgaagggaaacaaaatcattctagcaaagactctcatcgatctgcactctcagaaacttgacaagcggcgcgaggcccgacgtaatagaaggacgcggctgtcgcgcaaaaagagattggcgaggctccggtcatgggtcatgcgccagaaggttggcaaccagcgactgcctgatccatataaaataatgcatgacaataagtactggagcatctacaacaaaagtaattccgctaacaagaaaaattggattgatctgctcatccactctaacagcttatccgccgacgatttcgtgagaggtctgaccattatctttaggaagcgggggtatcttgcattcaaatacttgtcacgtctgagtgacaaggagtttgaaaagtatatagataatctaaaaccgcccattagcaagtacgagtatgacgaagatctcgaggagctgtcttcccgcgtagaaaacggagagatcgaagagaaaaagttcgaaggccttaaaaataagctggacaagattgacaaagagtcaaaggattttcaagtgaaacagagagaggaagtcaagaaagagttggaagacctcgtggatctgttcgccaagagcgttgacaacaagatcgataaagctaggtggaagcgggagttaaacaatctgctcgacaaaaaggtgcgaaaaatccgctttgataacagattcattcttaagtgcaagataaaaggctgtaataagaacacacctaaaaaggaaaaagtcagggactttgagctgaagatggtgttgaataacgcacggagtgattaccagatctctgacgaggatctaaattccttccgcaacgaagtaattaatatcttccagaaaaaggagaacctgaagaaaggggaactcaagggagttactatagaggacctgagaaaacaacttaataagacctttaacaaagccaagattaagaaaggtatcagggaacagatccgtagcattgtgttcgagaagatctcgggccggtctaaattttgcaaggagcatctgaaagagttctccgagaagccagctccctcagaccgaattaattatggggtcaacagtgccagagaacagcacgattttagggtgttgaatttcatagacaagaaaatctttaaggataaactcattgaccctagcaagctgcgctacatcacaatcgagtccccagagcccgaaaccgagaaattagaaaagggacagatttctgaaaagagcttcgaaactctgaaagagaagctagcgaaagagacaggcggtatagatatctacaccggggaaaagctcaaaaaggactttgagattgaacatatcttccctcgggcaagaatgggaccatcaattagggagaacgaagtggccagtaacctggagacgaataaagagaaggctgatcgcactccgtgggaatggtttggccaagacgagaagcgatggtccgagttcgagaaacgggtcaacagcctttattctaagaaaaagatctcagaacgtaaaagagagatattgctgaataagagtaacgagtaccccggcctcaatcctaccgaactgagcaggatcccatccacactttctgattttgttgagtcgattcgcaagatgttcgtgaaatatgggtacgaagaaccccagactctggtacagaagggaaaacctatcattcaagtggtccggggtagagacacccaggccttgaggtggcgatggcacgcactcgatagcaacatcataccagagaaggaccgcaaatcctcattcaatcacgctgaagatgccgtgattgcggcctgtatgcccccgtattacctgcggcagaagatctttagagaggaagcaaagattaaaaggaaggttagtaacaaagagaaggaagtgacacgtcctgacatgcccaccaaaaagatcgctccaaattggtctgagttcatgaagacgcgcaacgagcctgtcatagaagtgatcggcaaagtaaagcccagctggaaaaattccattatggaccagactttttataagtacttactgaaaccattcaaggataacctaatcaagattcccaatgttaaaaacacatacaagtggatcggggtgaatggacaaaccgactcactcagcctgccttctaaagtcctttccataagtaacaagaaagtggatagctctactgtcttgctggtgcatgacaagaaaggcggtaagcggaactgggttccaaagtccattgggggcctcctggtgtatatcacaccgaaagatggacccaagagaatcgtacaggtcaaacctgccacccagggcttactgatttacaggaatgaggacgggcgagtggatgctgttcgggaatttatcaacccagtgattgagatgtataataacggaaaacttgccttcgtcgaaaaggagaatgaggaagagttgctcaagtactttaacctgctagaaaagggtcagaaattcgagcgcataagaaggtatgacatgatcacgtacaattcaaagttttattacgtgaccaaaattaacaagaatcaccgggtaacaatccaagaagagagtaaaattaaggcagagagcgataaggtgaaatcgtcctctggcaaggaatacactcgaaaagagaccgaggaactgagcctccagaagctggccgagcttatctcaatatga

SEQ ID NO: 11357 - RNA, 2850 nt, synthetic construct
  misc_feature 1..2850: note = ARMAN Cas9 variant__Candidatus Micrarchaeum sp.__OJT94500.1__Cas9
  source 1..2850: mol_type = other RNA
atgagagacagcatcaccgcccccaggtactcctctgctctggcagcccggattaaggagttcaactcagcgtttaaactcggcatagatcttgggacaaagactggaggtgtggctctggtcaaagacaataaggttttgttagccaaaacgttcctggattatcacaagcagaccctagaagaacgccgaatccatcgtagaaacaggcggagtcgcctcgcaagaaggaagcggattgcccgcctgcgaagctggatccttagacaaaagatttacggcaagcagctgcctgacccatataaaatcaagaaaatgcagttgccgaatggggtgaggaagggagaaaactggatagatctcgtagtgtccggccgggacctgtctcccgaggcttttgtccgtgcaatcacactgattttccagaagcgcggtcaaagatacgaagaggtggccaaagagatcgaagagatgtcgtataaggaattttcaactcacattaaagctctcaccagcgttacagaggaggagttcaccgccttagcggcagagatcgaaaggcggcaggatgtggtcgacactgataaggaggccgaacgatacacacagctgagtgagcttttgtccaaagtgtctgagagcaagtccgaatcaaaagaccgcgctcagagaaaggaggatctggggaaggtagttaatgccttttgcagtgcacataggatagaagacaaagataagtggtgtaaagagctaatgaagctcctggaccggcctgtgcgccacgctagattccttaacaaagtcctgattaggtgcaatatctgtgaccgtgccaccccaaagaaaagccggcccgatgtgcgagaattgctctattttgacacggtgagaaacttcctgaaagcgggaagggtcgagcaaaatcctgatgttatttcttactacaagaaaatctatatggacgccgaggtgatccgcgtaaagattttaaacaaagaaaagctgactgatgaggacaagaaacagaagcggaaactcgcatccgaacttaatagatacaagaacaaagagtatgtgaccgatgctcagaagaagatgcaggaacaactgaaaacattgctatttatgaagctgactggcaggtcacgctactgcatggcccatctcaaagagcgagctgccggcaaggacgtcgaggaagggctgcacggagtggttcagaaacggcacgatcgtaatatagcacagagaaaccatgaccttagggtgatcaatctgattgagagcctcttgttcgatccaaacaagagtctgtctgacgccatccgcaaaaacggtttaatgtatgtcaccatagaagctcccgagcctaagacaaagcacgcgaaaaagggcgcagccgtggtacgggacccaagaaaactgaaggagaaactatttgatgaccaaaatggggtttgtatttacaccggactccagctggataaacttgaaatctccaagtatgagaaagaccatatcttcccggatagcagggacggcccctcgattcgagataacttggtgctgacgactaaggaaatcaattctgacaaaggtgatcgcacaccttgggagtggatgcacgacaacccagaaaagtggaaggctttcgagcggagagtcgccgagttttacaagaaggggaggattaatgaacgtaaacgcgagctcctgcttaacaagggaaccgaataccccggcgataatcctactgagctggcacggggcggggccagagtgaacaatttcataacagaatttaacgacaggttgaaaacccacggagtccaggagctccagacgatcttcgagcgaaataagccaattgtgcaagttgtgcggggtgaagagacccagcgcctgagaaggcagtggaacgctttaaatcagaactttatccccctgaaagatcgggccatgtccttcaatcatgcagaagacgcggctatcgccgcatcaatgccgcctaagttttggcgagagcaaatttatagaacagcctggcacttcggccccagtgggaacgaacgcccagactttgctctagccgagctcgcacctcagtggaacgatttctttatgactaagggaggccccataatcgctgtactgggtaaaaccaagtacagctggaaacattccattatcgacgatacaatttataagccattctctaaaagcgcctactatgtcgggatctacaagaaacccaatgcgataacttcaaacgccatcaaggtgcttaggcctaagttgctgaatggcgagcacaccatgagtaaaaacgctaagtattaccatcagaaaattggaaatgaacgttttctcatgaagtcccagaaaggcgggagcatcattacagttaagccacacgacggaccggagaaggtgctgcaaatctctcccacctacgaatgcgcagtcttaactaaacacgatggtaagataattgtgaaattcaagcctatcaaaccactgcgggacatgtatgccagaggcgtaattaaggctatggataaggagcttgagacgtcattgagtagcatgtccaaacatgccaagtacaaagaactccacacacatgacatcatatatctgcccgcaaccaagaaacacgtggatgggtacttcatcattactaagctatctgcgaagcacggaatcaaagccctgcctgagtcgatggttaaggtcaaatatacccagattggcagcgaaaacaattccgaggtgaagctcacaaaaccaaagcccgaaatcaccctggactcagaggatataactaacatttacaattttacaaggtga

SEQ ID NO: 11358 - RNA, 2961 nt, synthetic construct
  misc_feature 1..2961: note = CasX variant__Deltaproteobacteria bacterium__OGP07438.1__CasX
  source 1..2961: mol_type = other RNA
atggagaagagaatcaacaaaattaggaagaaactgagcgccgacaatgctaccaagcccgtgtcccggtctggccctatgaaaacactccttgtccgcgttatgactgatgacctgaagaagcgattggaaaaacgtagaaagaaaccagaggtgatgccgcaggtaatatcaaacaatgcagccaacaatttaaggatgctgctagatgactacacgaagatgaaagaagcgatcctccaagtgtattggcaggagttcaaggatgaccacgtcgggctgatgtgcaagtttgctcagcccgccagtaaaaagattgatcagaacaaacttaagcctgaaatggacgagaaaggaaatctgaccacagcaggtttcgcctgtagccaatgcggccagccattgtttgtgtacaagctcgagcaggtttccgaaaaagggaaggcttatactaactacttcggacggtgtaatgtggcagagcatgaaaagctgatcctgctcgcccagttaaaacccgagaaggattctgacgaggctgtcacctattcgctgggcaaatttggtcaacgcgcccttgatttctactcaattcacgtgacaaaggaaagcacccatcctgtaaaaccattggcgcagatcgcagggaacagatatgccagtggacccgttggcaaggctctgtccgacgcctgcatgggcactatagcatcttttctaagcaagtaccaggatatcattatcgagcaccagaaagtggtcaaggggaatcagaaaaggctcgaatccctgcgggagcttgctggaaaggaaaacctggagtacccttcagtgacattgccaccgcaaccccataccaaagagggtgtggacgcctataatgaagtcattgcgcgcgttcgaatgtgggtgaacctcaatctgtggcagaagttaaagctgagtagagacgatgccaaacctctccttaggctgaagggcttccccagctttccagtagtggagcggcgtgaaaacgaggtcgactggtggaacacgatcaatgaagtgaaaaagttgatagatgcaaaacgcgacatggggagagttttctggtctggagtgactgctgagaagaggaacaccattctagagggctacaattatctgcctaacgaaaatgatcacaagaaacgggagggttccctcgaaaacccaaagaaacccgccaagcgacaatttggggacctgcttctgtacttggagaaaaagtatgctggagattggggcaaagtcttcgacgaagcctgggagcgcatcgataagaagattgcaggcctcacatcacacatcgagagagaagaggccaggaatgctgaagacgcgcagagcaaagcagtgctgactgattggttacgggccaaggctagttttgtactggagcgcctaaaagagatggacgaaaaggagttctacgcctgtgaaatccagctccagaaatggtatggggacctgagaggaaacccgttcgcagttgaggccgaaaatagggtggtcgatatttctggtttttccataggcagcgacgggcattcgatccaataccgtaaccttttggcttggaagtacctggagaatggaaagcgggagttctatctcctgatgaactacggcaaaaagggtcgaattagatttaccgatgggacagacatcaaaaagtctggcaaatggcagggacttctgtatggcgggggaaaggccaaggtgatagatttgaccttcgaccctgatgacgaacagctcattatcctgcccttagcatttggtacgaggcagggccgcgagttcatctggaatgatctgctatccctcgaaactgggctgattaaacttgcgaacggacgggtcatcgagaagacaatttacaataaaaagataggcagagacgaaccagctttgtttgtggccctgaccttcgagaggcgcgaggttgtggatccttcaaacatcaaacccgtaaacctcattggtgtcgaccgaggggaaaatatcccagcagtgatcgccctgactgatcccgagggctgccctttaccagaatttaaggacagtagcggaggcccgacagacattctgcggataggggagggatataaggaaaaacaacgtgctatccaggccgcaaaggaggttgagcagagaagggctggtggctactcccgcaaattcgcctctaagagccggaaccttgcggatgacatggtgagaaattcagccagggatttgttttatcacgctgtcacccatgacgcagtgctcgtattcgaaaacctgagtcgagggtttggacgccagggcaaacggacgttcatgaccgagagacaatacacaaagatggaagattggctaactgccaaactggcttacgagggtctcacctccaagacatatctgagcaagactcttgcccagtacacctctaaaacatgttcaaattgcgggttcaccattactacggcagactatgatggcatgttggtgaggctgaagaaaacaagtgacggatgggcgaccactttaaacaataaggagctcaaagccgaaggccagatcacctactataaccgttacaagcgccagacagttgagaaggaactgagcgctgagcttgatcggctgtccgaagagtctgggaataacgacatttcgaaatggaccaagggaagaagggatgaggccttgtttctcctgaaaaagcgattcagccaccggcccgtccaagaacagtttgtgtgtctagactgcggccacgaggtgcatgcagatgaacaggctgccctgaatatcgcacgctcctggctgttcctcaactcaaatagtactgagtttaaatcttataagagcggtaagcaacctttcgtcggggcctggcaggctttttacaaaagaaggcttaaggaagtttggaaaccaaacgcgtga

SEQ ID NO: 11359 - RNA, 2937 nt, synthetic construct
  misc_feature 1..2937: note = CasX variant__Planctomycetes bacterium__OHB99618.1__CasX
  source 1..2937: mol_type = other RNA
atgcaggagatcaagagaattaacaaaataaggcggcgcctggtgaaggacagcaataccaaaaaggccggcaaaacagggcccatgaagactctccttgtccgagttatgacgcctgatctgcgtgaaagattggagaacttaaggaagaaaccagaaaatatcccgcaacccatttccaacacctctcgggctaatctgaacaagctactcacagactacactgagatgaaaaaggcaatcctgcacgtgtattgggaagagttccagaaagatcctgtaggacttatgtcacgcgtggcccagccagcgcccaagaatattgaccagagaaagctgatccctgtcaaagatggtaacgagaggttgaccagtagcggctttgcttgctcccaatgttgccagccactctacgtgtataagctggaacaggttaatgacaaagggaagccccatacaaactacttcggacggtgtaatgtgtctgagcacgaacgcctgatactcttatcgcctcataaaccagaggccaacgatgagctggtcacctattcacttggcaagtttggtcagcgagcattggacttctacagcatccacgtgactagagaaagtaatcatccggtaaaacccctggagcaaattgggggaaactcctgcgcctctggccctgttggcaaggctctaagcgatgcatgtatgggggccgtggcttcctttctcacaaagtatcaggacatcattctggaacaccagaaagtcatcaagaaaaatgagaagaggcttgccaacctgaaagatatagcgtcagcaaacggattggccttcccaaagattacccttccccctcagccacacacgaaggaaggtatcgaggcttacaataacgtggtggcccaaattgtcatctgggttaatctgaacttatggcagaaactgaagatcggccgggacgaggcaaaacccctccagcgtcttaaggggtttccgagtttccctctggtggaacgccaagctaatgaggtagattggtgggacatggtgtgcaacgtcaaaaagttgattaatgaaaagaaagaggacggaaaggtgttttggcagaacctagccggctacaaaagacaggaagcgctgctcccctatctgagctctgaggaggataggaagaaaggtaagaagttcgcccggtaccagtttggggaccttctgttgcatctcgaaaagaagcacggagaggattggggcaaagtttatgacgaagcatgggagcgaatagataagaaagtggaaggcctgtccaagcatatcaaattagaggaggaacgcagatcagaggacgctcaaagcaaggccgctctgactgattggctaagggccaaggcaagtttcgtcattgaagggctcaaagaggccgacaaggatgagttttgtcggtgcgaactgaaacttcagaagtggtacggagacttgcgcggtaaaccattcgctatcgaggcggaaaattctatactggatatttccggcttcagcaagcagtataactgtgcatttatctggcagaaggacggggtgaaaaagctcaatctgtaccttatcattaactatttcaaaggaggcaagctgagatttaaaaagatcaagcctgaggccttcgaagctaataggttttacaccgtaattaacaaaaagtcgggtgagatagttcccatggaggtgaatttcaactttgacgatccaaacttgatcattctccccctggccttcgggaaacgtcaaggccgggaatttatctggaatgacttactgtctctagagacaggatccctcaagctggcaaacggccgagtcatcgagaaaactctttacaatagaaggacccgccaggatgaacctgccttgttcgtggctctgacatttgaacggagagaggtcctcgactcaagtaacattaagccaatgaatctgatagggatcgataggggagagaacattccggccgtgatcgcattaaccgaccccgaaggttgccctctgagccgcttcaaggattcccttggcaatccaacgcacattttgcgaatcggggagtcttataaagaaaagcagcggactatacaggcggctaaagaggttgaacaacgtagagccggaggctacagcaggaagtatgcatcaaaagccaagaacctcgctgacgatatggtgcgcaatacagcccgggacctgctatactatgcagtaacccaggatgctatgctgatctttgagaacctcagtagaggtttcgggaggcagggcaaacgaactttcatggccgagcgccagtacacacggatggaagactggctgaccgcgaaacttgcctatgagggattgccctccaagacgtacctgagcaaaaccttagctcaatacacatctaagacttgttcaaattgcggctttaccattacaagtgcagattatgacagagtcctcgaaaaactgaagaaaactgccaccgggtggatgacaaccatcaacggaaaggagcttaaggtggagggtcagattacttactataataggtacaaacgtcagaacgttgtgaaggacctgagcgtcgaattggatcgcctctccgaggaatctgtgaataacgacatctcgagctggacgaaaggccggtccggggaggctctgtcactactgaagaaaagattcagtcacaggcctgtacaagaaaagtttgtgtgcctcaactgtggattcgagacacatgccgatgagcaggcagcgctgaatatagcccgatcttggctctttttgcggagccaggaatataagaaataccagaccaacaagactaccggcaatacagacaaacgcgctttcgttgagacctggcaatccttttatagaaagaaactgaaggaagtctggaagccagccgtgtga

SEQ ID NO: 11360 - RNA, 3378 nt, synthetic construct
  misc_feature 1..3378: note = CasY variant__Candidatus Katanobacteria bacterium__OJI08769.1__CasY
  source 1..3378: mol_type = other RNA
atgagaaagaaactgttcaagggctacatcctccacaacaaaaggcttgtgtataccgggaaggccgctattcggagcataaaataccccctggtcgcacctaataagacagccttgaacaatttatccgagaagatcatttatgactacgaacatctgtttggaccactaaacgttgcgtcttatgctcgcaattcaaaccgatacagtctcgtggatttctggatcgacagcctgcgtgccggtgtaatttggcagtccaaatctacttcgcttatcgatctgatatcaaagttggagggcagcaaaagtccgtccgaaaagatctttgagcaaattgacttcgaactcaaaaataagctggataaggagcagtttaaagacatcattctgctcaacacggggatcagatctagctccaatgtgaggtcattacggggacgcttcctgaagtgctttaaagaggagttcagagataccgaggaagtcatagcatgtgtggacaagtggagtaaagatcttattgttgagggcaagagcatcttggtgtctaaacagtttctgtattgggaggaagagttcggtattaagatctttccccacttcaaggacaaccatgatctacctaaactcacatttttcgtcgaaccatccctggagttctcaccccaccttcctctggccaattgcttggaaaggctcaagaaatttgacatcagccgggagagtctgttagggctggataacaatttctctgctttttccaactacttcaatgagctctttaaccttctgagccgcggagaaattaagaaaatagtgactgcagtattggccgtttcgaagtcttgggagaacgaaccagagctagaaaagcgactgcatttcctctccgagaaagctaagctgcttggctaccccaaactgacctcaagttgggccgactatagaatgatcattggcgggaagatcaaaagctggcactccaattacacagagcagttgataaaggtgagggaagacctcaagaaacaccaaattgcgctggataagttacaggaggacctgaaaaaggtcgtggattctagcctacgggaacagatcgaggcacagcgtgaagccctcctgcctcttttggacaccatgctgaaagagaaggatttttcagacgatctcgagctgtatcgcttcatccttagtgactttaagtccctgttgaacggaagctaccaaagatatattcagactgaagaggaaaggaaagaggatcgggacgtgacaaagaaatacaaggatctctattctaatctgcgaaacatcccacgcttctttggtgagtcaaagaaggaacagttcaataaatttattaacaagagtttaccgaccatagacgtcggcctgaagatcctagaggacattagaaatgctctcgaaacggttagcgtgaggaaacccccttccatcactgaggaatacgtaaccaagcagctggagaaactttctcggaagtacaaaatcaacgccttcaattcgaaccgcttcaagcaaattacagaacaggtgttgagaaagtataataacggggaactgccaaaaataagcgaggtcttttacaggtatccccgtgaatcccatgtggcaatccggattctccctgttaagatctcaaatccacgaaaagatattagttacctgttagacaagtatcagatctctcccgattggaaaaacagcaatccgggagaggtggtcgacctgatagaaatctacaaacttactttgggctggctcctgtcctgtaacaaggatttctcaatggactttagctcttatgatctaaaactgttccctgaggctgcctccctcattaagaactttggtagttgcctgagcgggtactacctttctaaaatgatcttcaattgtattacctccgagatcaagggaatgataacattgtataccagagacaaatttgtggtaaggtacgttacgcaaatgattggctcaaaccagaagttccccctgttatgcctcgtgggcgaaaagcagactaaaaattttagtcgcaactggggagtcctgatcgaggaaaagggggatcttggtgaggaaaagaatcaggagaagtgtctgattttcaaagacaagacagattttgcgaaagccaaggaggtggaaatcttcaagaacaatatatggcggatcagaaccagcaaatatcaaattcagtttttgaaccgcctcttcaagaaaactaaggagtgggacctgatgaatctagtcctgtcggaaccatccctcgtgctggaggaggaatggggcgtttcttgggataaagacaaacttttgcctctgttaaagaaagaaaagagctgcgaggagaggctctactattcactgccccttaacctggtgccagcaacagactacaaagaacagagtgctgagatcgagcagcgaaatacctatctagggctcgatgtaggagagttcggcgtcgcctacgctgtggttcggattgtgcgtgacagaatcgaactgttgtcctggggttttctgaaggatcccgccttaaggaaaatacgcgaacgggtccaagacatgaagaagaaacaggtgatggcagtattctctagctcctcaacggccgtggctagagttagggagatggcgattcacagcctccgaaaccagatccatagtatcgcactggcctacaaggctaaaattatctatgaaatttctatatccaattttgagaccgggggcaaccgcatggccaagatctaccggagcattaaagtctcggatgtgtatagagagtcaggagcagacacacttgtgtctgaaatgatctggggcaagaagaataaacagatggggaaccacattagttcctacgccactagctatacctgttgcaactgtgctaggacacctttcgagctggtcatcgataatgacaaggaatacgagaaaggaggtgatgaatttatattcaacgttggcgacgagaagaaagtgcgtgggtttttgcaaaagtctctcctgggaaagactatcaaaggcaaggaggtgctaaaaagcattaaggaatatgcccgcccaccgatccgggaggtactgcttgaaggtgaggatgtcgagcagctcctgaaaagaaggggcaattcctacatttaccgatgccccttctgcgggtataagaccgacgcagatatccaggcggctttgaacatagcctgtcggggatacatttcagacaatgcaaaagacgccgtgaaggaaggcgagcgcaagctggattatatcttagaagttagaaaactctgggagaagaacggggctgtgctgaggagtgccaaatttctttga

SEQ ID NO: 11361 - RNA, 3864 nt, synthetic construct
  misc_feature 1..3864: note = CasY variant__Candidatus Kerfeldbacteria bacterium__OGY82221.1__CasY
  source 1..3864: mol_type = other RNA
atgaagagaatcctgaacagcctcaaagtggccgctcttaggctgttgttccggggcaaggggtccgagttagtcaaaaccgttaagtaccccctggtgtctcctgtacagggagcagtggaagaactagccgaagcgattcgccacgacaatctccatctgtttggtcaaaaagagatagtcgatcttatggaaaaggacgagggcacacaggtgtattcagttgtggatttctggctggacactttgcgactcgggatgtttttcagtccaagcgctaacgccctgaagatcacgctgggaaaatttaattccgatcaggtctctccgttccgtaaggtgctcgagcagtcgccctttttcttagcaggcagactgaaagtagaacctgccgagaggattctttcagttgaaatccggaagattggtaaacgcgagaacagagtggagaattacgctgcagacgtcgaaacctgctttatcgggcaattgagcagtgatgagaagcagtccatacagaagctggccaacgacatctgggattctaaagaccacgaggagcagaggatgctaaaggctgatttctttgccattccactcatcaaagaccccaaggcggtgacagaagaggatcctgagaatgaaactgcaggaaaacaaaagccactggagctttgtgtgtgcctggtccccgaattgtatacccggggcttcggcagcattgccgactttctcgttcagcgcctgacattactgcgagacaaaatgtccaccgatactgctgaggactgtctcgaatacgtggggatcgaggaggaaaagggaaacggtatgaactcacttctgggcacattcttgaagaatctacagggggatggattcgagcagatatttcaattcatgctgggcagttatgtaggttggcaggggaaagaagacgtgctcagagagaggctggatcttctggccgaaaaggtcaaacggttgcctaagccaaaatttgcaggagagtggagcggccatcgtatgttcctccacggccagctgaagtcttggtcctcaaactttttccgcttatttaatgagaccagagaactgctagagagcattaagagtgacatccaacatgctacgatgctcatttcttacgtggaagagaaagggggatatcacccgcagctgctttcccagtacaggaagttgatggagcagctgcccgccctccggactaaagttctggatcctgaaatcgagatgacccacatgagcgaagcggtgcgatcgtacatcatgattcataagtctgtcgccggtttccttccagacctgttggagtccctcgatcgcgacaaagatagagaatttctgttatcaatattccccaggatccctaagattgacaagaaaacaaaggagatcgtggcatgggagctgccaggcgaacccgaggaagggtatctatttactgctaataacctcttccggaattttctggagaacccgaaacacgtacctcgcttcatggccgaaagaatacccgaggactggaccaggcttcgtagtgctccagtttggttcgatggaatggtgaagcaatggcagaaagtcgtgaaccagttggtcgagagccctggcgccctgtaccagtttaatgaatccttcctccggcaacgactgcaggcaatgttaacagtgtataagagagacctgcagaccgagaagtttcttaaattgctcgccgatgtttgcaggcccctggtggacttctttggtctagggggcaacgatattatcttcaagtcttgtcaggacccacgcaaacaatggcagacggtaatccccctgagcgtccctgctgatgtgtacactgcgtgcgaaggactcgcaattcggctgagagagacacttggctttgaatggaagaatttgaaagggcatgagagggaggacttcctgcgcttacaccagctcctgggaaaccttctgttttggatccgagatgccaagttggttgtgaaactcgaagactggatgaataacccatgtgtccaggagtatgtggaagctcggaaggccattgatctgccgctagagatattcggttttgaggtacccatcttcctgaatggctacctcttttcagaactgcgtcaacttgagttgctgttaagaaggaagagtgtgatgacctcctatagcgttaaaactacagggtctcctaaccgcctcttccagctggtctaccttccactgaatccctcagaccctgaaaagaaaaacagtaataacttccaggagcggctagataccccaacgggactcagcagaaggtttctggacttgaccctggacgcattcgccggcaagttactcacagatcccgtgactcaagaactgaaaaccatggctggtttttacgaccaccttttcgggtttaagctgccgtgcaagttggccgcaatgtccaatcatcctggatcttcgagcaaaatggtggtcctcgcgaagcccaaaaagggagttgcttccaacattggcttcgagccaatccctgatcccgcccacccagtgtttcgagtgcgctcaagttggcctgagctgaaatatctagaagggctgctttacctccccgaggacacaccactgactatcgaattggcagagacctctgtaagctgtcagtccgtctcaagcgtggccttcgatctgaagaatttaacaaccattctcggacgggttggtgaatttagagtgactgctgaccagccgttcaagctgacgcctataatccccgagaaagaggaatcttttattggcaagacatatcttgggctggatgccggagagaggtccggcgtcggtttcgcaatcgtgaccgttgacggggatggctacgaagtgcagcgtttgggagtacatgaggacactcaactcatggctctgcagcaggtcgccagtaaaagcctaaaggaaccagtgttccagcccctgcgcaaaggcacctttcggcaacaggagagaattaggaagtctcttcgagggtgctattggaacttctaccacgcgctcatgatcaagtatcgggccaaagtggtccatgaggaatccgttggatcaagtggcctggtgggtcagtggttgcgcgcttttcagaaggatctgaaaaaggcagacgtattacctaaaaagggcggcaaaaacggggtggataagaagaaaagagagagctcggcccaagacacactctggggtggcgctttctccaagaaagaggaacagcagatagcctttgaggtccaagcagcggggtctagccagttctgtctgaagtgcggatggtggtttcagcttggcatgagggaagtgaatcgggttcaggagtcaggggtggtcctggactggaaccgaagtatcgtgaccttcttgattgaatcctctggagagaaagtttacggctttagcccacaacagctagaaaagggtttcagacccgatatcgagacttttaagaaaatggtgcgcgacttcatgaggcctccgatgtttgatcgtaaggggcggccagccgctgcctacgagagattcgtcctgggaaggcgccaccgaagatatcggttcgacaaagtatttgaagagaggttcggccgctccgcactctttatttgcccccgtgtgggttgtggcaatttcgatcactcaagcgaacagagtgctgttgtgctggcccttatcgggtacatagcagacaaggagggaatgtctggcaaaaagttagtctatgtgagactggccgaactcatggctgagtggaagttgaaaaagctggagcggtccagggtagaggaacagagctcggcgcaatga

SEQ ID NO: 11362 - RNA, 3579 nt, synthetic construct
  misc_feature 1..3579: note = CasY variant__Candidatus Komeilibacteria bacterium__OJI06454.1__CasY
  source 1..3579: mol_type = other RNA
atggccgagagcaagcagatgcaatgcagaaaatgtggcgcttccatgaagtacgaagtgatcgggctggggaaaaagtcttgcaggtatatgtgtcccgactgcggtaaccacacctcagcacggaaaattcagaataagaagaaacgcgataagaaatacggcagtgccagcaaggcgcagtcccagcgaatagctgtcgccggggcactctatcctgacaaaaaggttcaaacaatcaagacttacaaatatccagccgatcttaacggagaggtgcatgaccgtggcgtagctgaaaagattgagcaggcaatccaggaagatgagattggtctgttggggccgtcttcggagtacgcctgttggatcgcttcacagaaacaaagcgaaccctatagtgtggtcgacttctggtttgatgccgtgtgcgcgggaggcgttttcgcatactccggcgccagattactgtctacggtgctacagctcagcggggaggaatccgtcctgagggctgcccttgcatcaagtccttttgtggacgatataaatctggctcaggccgagaagttcttggcggtaagccggcgcaccggacaggacaaactcggtaagagaatcggcgagtgttttgccgaagggaggctggaggcactgggaattaaagatcggatgcgcgaatttgttcaagctatcgacgtggcccagacagctggccagcgatttgccgcaaagctcaagattttcggtatctctcaaatgccagaggccaaacagtggaacaatgattccgggttaactgtctgcatactgcccgactactatgtgcctgaagagaacagagctgaccagcttgtggtcttgctgaggcggctacgtgagattgcgtactgtatgggaatcgaagatgaggcaggctttgaacacctcggcattgacccaggggccctgtcaaatttcagcaacggaaatcccaagcgcggttttcttggcagactgttgaacaatgatatcatcgctctcgccaacaatatgagtgcaatgaccccttattgggaggggaggaaaggagaactgattgagcggttagcctggctgaagcatcgagctgagggcctctaccttaaagaaccacacttcggtaactcttgggccgaccatcgctccagaatatttagcaggatcgcagggtggctgtcgggctgcgcgggaaagttgaagattgctaaagatcagatctctggcgttcggacagacctattcctgctcaagcgcctgcttgatgccgtgccgcaatccgcaccctcacctgacttcatagccagtattagcgctctggatagatttttggaggccgcagaatcctctcaggacccagctgagcaggtaagggccctctatgcgttccacctgaatgcccccgctgtgcgtagcatcgcaaacaaagccgtccagcggtcagatagtcaagaatggttaatcaaggagctggacgctgtggaccacctagagtttaacaaagccttccctttcttctccgataccgggaagaagaaaaagaaaggagcaaatagcaacggtgcgccatctgaagaggaatacactgagacagagtcaattcagcagcccgaagacgccgagcaggaagttaatggccaagaggggaacggagctagtaagaatcagaaaaagtttcagcgaatcccgagattctttggcgaaggtagcaggtccgagtatcgcattctcaccgaggcccctcagtacttcgatatgttttgtaacaatatgcgggcaatattcatgcaactggaatctcagcccagaaaggctccaagggactttaaatgcttccttcagaaccgcttgcaaaagctgtacaaacagacgttcctcaatgcccgatcgaacaagtgccgggcactgcttgagagcgtgctgatctcctggggagaattttatacttacggcgccaatgagaaaaagttccgtttgagacatgaggcttcagaaaggagttctgatcctgactatgtcgtgcagcaggcgctcgagattgcccgccggctgtttttattcggatttgaatggagagattgtagcgcaggcgagagggtagacctggttgaaatccacaaaaaggctatctccttcctactcgccattacccaagccgaggtgtcagtcgggagctacaactggctgggaaattctacagtgtcccgatatcttagtgtcgctggtactgataccttgtacggcacacagctggaagagtttctcaacgcaaccgtgctgagccagatgcgcgggttagccatacggctgtcttcccaggagcttaaggacggattcgatgttcaattggaatcaagttgccaggacaatctccagcatctgctagtgtatagagcgagcagggatctggctgcctgtaaacgtgcaacgtgccccgccgagctcgacccaaagatcctggtacttcccgctggcgcatttattgcctcggtcatgaaaatgatcgaacgcggtgacgagcctttggcgggggcttacctgcggcacagaccacactccttcggctggcagattagggtgcgaggagttgccgaggtgggcatggatcaagggactgcattagcctttcagaagccgacagaatctgagcccttcaaaatcaagccttttagcgctcagtacggaccagtcctctggctgaactcaagttcctattctcaaagccagtaccttgacggcttcctgtcccagcccaagaactggtcaatgcgggtgttgcctcaggccggtagcgtacgcgtggaacaaagagttgcactcatatggaatctgcaggctgggaaaatgaggctagagcggagtggagcccgagcgttctttatgccagtccccttctcttttagaccgtccggcagcggtgatgaagccgtgctggcacctaaccgctatctcggcctgttcccacattcagggggaatcgagtacgctgtggtcgacgttcttgattcggccggctttaagattttggagagggggaccatcgctgtgaatggattctctcagaaacgtggcgaacggcaggaggaagcacacagagagaagcaaaggcgcggtattagtgacatcgggcgaaagaagcccgtgcaggccgaagtagatgccgctaacgagctgcatagaaagtatactgacgtcgcgacacggttaggatgtaggatagtggttcagtgggcacctcagcccaaaccaggcaccgcccctacggctcaaaccgtgtacgcccgcgcagtccgtacagaggcccccagatccggtaatcaggaagatcacgctcggatgaaaagctcttggggctatacttggagcacctactgggagaaaaggaagccagaagacattctcgggatctccacacaggtgtactggactggaggcattggggagtcatgcccggcggttgccgtggcactgcttggacatatccgcgctaccagtacacagaccgaatgggagaaagaggaagtagtctttggccgactgaagaagttctttcctagctga

SEQ ID NO: 11363 - RNA, 3633 nt, synthetic construct
  misc_feature 1..3633: note = CasY variant__Candidatus Parcubacteria bacterium__APG80656.1__CasY
  source 1..3633: mol_type = other RNA
atgagcaagagacaccccaggatctccggcgtgaaagggtaccggctgcatgcccagcgcctcgagtataccggaaagtctggtgctatgcgaacaattaaataccctctttattcaagtccaagcggcgggcgtactgtcccgagagaaatagtttccgcaatcaacgacgattacgtgggactgtatggcttgtctaatttcgacgatttatacaacgccgagaagaggaatgaagagaaagtatattcggtgctggacttttggtacgattgcgtccaatacggtgcggtgttctcatatacggctcccgggctactcaagaacgttgccgaagtgcggggaggcagctacgagctgaccaagacacttaaaggcagtcacctgtatgacgagttgcagattgataaggtcatcaaatttctcaataagaaagaaatttcccgcgcaaacgggtctctggacaagctgaagaaagatatcatagactgtttcaaggccgagtacagagaaaggcataaagatcagtgcaataagctcgctgacgatatcaaaaacgcaaagaaagacgccggagctagcttaggtgagcggcagaagaagctgtttcgcgacttctttggcatttccgagcaatcagaaaatgataaacctagtttcactaacccacttaatttgacctgttgcctgctaccctttgacacagtgaacaataaccgaaatagaggggaggtactcttcaacaagctgaaagaatatgcccagaaacttgataaaaacgagggaagcctggaaatgtgggagtacatcggcattggtaattctgggaccgcgttttccaacttcttgggagagggctttctcggcaggctgcgggaaaataagatcactgagttaaagaaagcaatgatggacataacagatgcctggcgtgggcaggaacaggaggaggaactggagaagcgcctcaggattcttgctgccctgaccatcaaattgagagaacctaagttcgacaaccactggggaggttatcggtcagatattaatggcaaactaagcagttggctgcaaaactacatcaatcagacggttaagatcaaggaggacctcaaagggcataagaaagatctgaagaaagcaaaggaaatgattaaccgattcggagagtctgacactaaggaagaggctgtggtctccagccttctggagtcgatagaaaagatcgtgccagatgactctgccgacgatgagaagcccgacattcctgcgatcgccatataccgcagatttttgtccgatggcaggctcaccctgaatcggttcgtgcagcgcgaagacgtccaggaggcattaattaaagagagactggaagctgagaagaaaaagaaaccaaagaagaggaaaaagaaatcagatgccgaagacgagaaggaaacaatcgattttaaagagctattcccgcacctcgctaagcccctgaaacttgttcctaacttttatggtgacagtaaacgtgagttgtacaagaaatataagaatgccgcaatctacactgatgccctgtggaaagctgtggaaaagatttataagagcgcgttctcctctagcctcaaaaactcatttttcgacaccgattttgacaaggatttctttatcaaacggctgcaaaagattttcagtgtataccgaagatttaatacagacaaatggaagccaatagtgaagaactccttcgcaccctattgtgacatcgtcagccttgccgagaatgaagtgctgtacaaacctaagcagtctaggtcacgcaaaagtgctgccattgataagaaccgggttagattgccaagcaccgagaacatcgcaaaagccgggatcgctctcgccagggaactgtccgtggcaggcttcgactggaaggatttactgaaaaaggaggagcacgaagagtacattgacctaatagaactccataagacggcgctggctcttttgctggccgtcactgagacacagctcgatatctctgcactggactttgtggaaaatggaaccgtaaaagatttcatgaagactcgcgacggcaacttagttctggaggggcgatttcttgagatgttctcgcaaagcattgtgttttccgaattgcggggactcgccggtctgatgtcacgtaaagagttcatcacaagaagtgctattcagaccatgaatggcaagcaggccgaactactgtatatcccccacgagtttcagtctgcaaaaataacgaccccgaaggagatgagcagggctttcctcgatctggcccctgcggaatttgccacatcccttgagcccgaatcattgagcgagaagtctctgttaaaactcaagcaaatgcgctactatccacattacttcgggtatgaactgactcggaccggacagggcatcgacggtggggtcgctgagaacgcacttagactggagaaatcccctgtgaagaaaagggaaattaagtgcaagcagtacaaaacattgggccgaggacagaataagatcgtcctctatgtgcgcagtagctactaccaaactcagtttctggagtggttcctacaccggcccaaaaacgttcagaccgatgtggccgtatctggctcctttctgattgacgaaaagaaagtcaagacaagatggaattatgatgctctcaccgtggccctggagccagtttcagggagtgaaagggtgttcgtcagccagcccttcactatctttcctgagaagtcggcagaggaagagggacaacgttaccttggtatagacattggcgaatatgggatcgcgtacacggccttggagattacaggagactccgctaaaatcctggatcagaacttcatatctgacccacagttaaagaccctccgcgaagaggtgaaaggcctgaaacttgatcagcggagaggtacttttgccatgccgagcaccaagatcgcaaggattcgagagtcactggtacacagtctacggaatcgcatccatcacctcgctctgaagcataaggccaaaattgtgtatgaattggaggtttccagattcgaagaggggaagcaaaagatcaagaaagtctacgcaacactgaagaaagccgacgtgtattctgagatagatgctgacaagaacttacagaccactgtgtggggcaagctcgcggtcgccagcgaaatttccgcatcatacacaagccagttttgtggagcttgcaaaaagctgtggagggccgagatgcaagttgatgaaacgatcaccactcaggagcttatcggcacagtgcgggtgattaaagggggaaccctgatcgacgccattaaggatttcatgcgaccccctatatttgacgaaaatgatacaccattccccaaatacagagacttttgtgacaagcaccatatcagtaagaaaatgcgcggcaactcttgcttgttcatttgtcctttttgcagggctaatgcagatgccgacatccaggcgtcccagactattgctctcctgcgttatgtaaaggaggagaaaaaggtcgaagattacttcgagcggttcagaaaactaaagaacatcaaggtgctgggtcaaatgaaaaagatatga

SEQ ID NO: 11364 - RNA, 3681 nt, synthetic construct
  misc_feature 1..3681: note = CasY variant__Candidatus Vogelbacteria bacterium__OJI07455.1__CasY
  source 1..3681: mol_type = other RNA
atgcagaaggtgagaaaaaccctgagcgaggtccacaagaacccctacggcacaaaagttaggaatgccaagactgggtattccctccaaatcgaacggctttcttacacgggaaaagagggtatgcgctcattcaagattcctctggaaaacaagaataaagaggtgtttgacgagttcgtaaagaaaatacgaaacgattatatcagtcaggtgggcttgttaaatctgagcgactggtacgaacattatcaggagaagcaggaacactactccctagctgatttttggctcgactctctgcgtgcaggggtcattttcgcccataaagagaccgaaatcaagaaccttatttcgaagatcagaggagataaatcaatagtggacaagtttaatgcgagcatcaaaaagaaacacgctgatctgtatgccttggttgacattaaggcactctacgatttcctgacaagtgacgccaggcggggcctgaaaactgaggaggaatttttcaactccaagcgcaataccctctttccaaagttcagaaagaaggataacaaagctgtggacttatgggtcaagaaatttatcggtctggataataaggacaaacttaacttcaccaaaaagtttattgggttcgacccgaatccccaaatcaaatacgatcatacattctttttccaccaggacataaactttgatttggagaggattactacacctaaggaactgatctctacctataaaaagttcctaggaaagaataaagacctctacggcagcgatgagacgactgaagaccagctgaagatggtgcttggctttcacaacaaccatggggcattctccaaatattttaatgcctcactggaggctttccggggacgcgataacagtttggtagagcagattatcaataacagcccatactggaactctcaccgaaaggaactcgagaaaagaatcatttttctgcaagttcagtccaagaagataaaagaaaccgagttaggtaagccccatgaatatctggcctcattcggcgggaaatttgagagctgggtgagtaattacctcaggcaggaggaagaggtcaagcggcagcttttcggatatgaagagaataaaaagggccagaaaaagtttatcgtgggtaacaagcaagaactggacaaaattatccgtgggacagatgagtacgagataaaggcgatttctaaagaaactatcggattgacccagaagtgcctaaaactgctcgagcaactgaaggactccgtggatgactacacacttagcctgtatcgccagttgatcgtcgaactcagaattaggctgaatgttgagttccaggagacctaccctgaattaatcggcaagtcggagaaagacaaggaaaaagatgcaaagaacaaacgggccgacaagcgatatccacagattttcaaggatataaaactgatccccaattttctaggcgagacgaagcaaatggtgtacaaaaagttcattcgctctgctgacatcctctatgaagggatcaactttattgatcagatagacaaacagatcactcagaatctgcttccttgtttcaagaacgataaggagagaattgagtttacagaaaaacaattcgagaccttgaggcggaagtactatctgatgaactcctcacgctttcaccacgtaatcgaaggaattatcaataacagaaaactcatagagatgaagaaaagggaaaatagtgagctgaagactttcagcgactccaaatttgtgctttctaagctgttcttgaagaaaggtaagaaatacgagaacgaagtctactatacattttacatcaatccaaaggcccgtgatcagcggcgaattaaaatcgtgctcgacattaacggcaataacagcgttgggatcctgcaggatttagtgcagaagctgaagccgaaatgggacgatataattaagaaaaatgacatgggagagctaatcgacgcaattgaaatcgagaaggtcagactcggcatactgatcgctctttattgcgaacataaattcaagattaagaaagagttgctgtcactcgatctgtttgccagtgcgtaccaatatttagagctggaagacgatcccgaggaactttccggtaccaacttggggaggttcctccagagcctggtgtgttctgagatcaagggcgccattaataaaatctcacgcacggagtacatagaacggtataccgtacagcctatgaacacagagaagaattacccactactgattaacaaagaaggaaaggcaacttggcacatcgctgccaaggacgatctcagtaaaaagaaaggcgggggaaccgttgctatgaatcagaagatcggtaaaaacttctttggcaagcaagactacaagacagtgttcatgctgcaggataaaagatttgaccttttgactagcaagtatcatctgcagttcttatccaaaaccctcgatacagggggaggctcttggtggaagaataaaaacattgacctgaacctttcgagctactcctttatcttcgagcaaaaggtcaaagtggaatgggatctgaccaatttggaccaccccattaagataaagccttcagagaacagtgatgacaggcgcctctttgtctctatcccattcgtgattaaacccaagcagactaaacgaaaggacctgcagacgcgggttaattatatgggtatcgatattggggagtacggcctagcctggacaatcataaacatcgacctgaaaaataagaagattaacaaaatcagcaagcagggatttatttatgaaccgctcacccataaagtgcgtgattacgtagcaactatcaaggacaatcaagtcagaggcaccttcgggatgcctgatacaaaactggccaggcttcgcgagaacgctataacctccttgcggaatcaggtgcacgacattgcgatgagatatgatgcaaagcccgtttacgaatttgagatctcaaacttcgaaactggaagcaataaggtgaaagtcatctacgactctgtgaagagggccgatattggtcgaggccagaacaatacagaggctgacaacacggaggtaaatctggtgtgggggaaaacctccaagcagttcggaagtcaaataggcgcctatgcaactagctacatctgctctttttgtggttattccccatactatgagttcgaaaactcaaaaagtggggatgaagagggcgcccgcgacaacttataccagatgaagaagctcagccggccttcgctggaagactttcttcagggaaatcccgtttataaaacattcagagattttgacaagtacaaaaacgatcagaggctgcaaaagaccggcgacaaagatggggagtggaagacacaccgtggaaatactgctatttacgcctgccagaaatgtcgccatatctccgacgcagatattcaggcgtcttattggatcgctctaaagcaagtcgtgcgggacttctacaaggataaagagatggacggcgatctcatacagggtgacaacaaggataaaagaaaggtgaatgaactgaacaggttgatcggggtccacaaagacgttccaattatcaataagaacctgattaccagcttagacatcaatctcctgtga

SEQ ID NO: 11365 - RNA, 3603 nt, synthetic construct
  misc_feature 1..3603: note = CasY variant__Candidatus Vogelbacteria bacterium__OJI09436.1__CasY
  source 1..3603: mol_type = other RNA
atgaaggccaaaaagagcttctacaaccagaaaagaaagtttggcaaaagggggtatcggctgcacgacgagcgcatcgcttactccggaggtattggctctatgcgatcaataaagtatgaactcaaggatagttacgggatcgcaggacttcgtaatagaattgccgacgcgaccatcagcgataacaaatggctgtatggcaatattaacttgaatgactacttagagtggaggtcctctaagacagataaacaaatcgaagacggtgatcgggagtcgtcactgctagggttctggctcgaagctctgcgccttggatttgtgttcagcaagcagagtcatgcccccaacgactttaatgagactgcactgcaggatttgttcgagacgctcgacgatgacctgaaacacgtcctggatagaaagaagtggtgcgactttataaaaatcggcacccctaagacaaacgaccagggcaggctcaaaaagcaaattaaaaatttactgaaggggaacaaacgggaagagatcgaaaagactcttaatgagtccgatgacgagttgaaggaaaagattaaccgcatcgccgatgttttcgctaagaataaatctgacaagtataccatatttaaactggataagccaaacacagagaagtacccgcgaattaatgacgtgcaggtagcattcttttgtcatcccgatttcgaagagatcaccgaaagagacaggactaaaacactagatctcattatcaaccggtttaacaagcgttacgagatcaccgagaataaaaaggacgataaaacgagcaaccgcatggccctgtattcccttaatcagggatacattcctagagtgctgaacgacttgttcctcttcgtcaaggacaatgaagatgacttttcacagttcctgagtgatttagagaactttttcagcttttctaatgaacaaataaagatcattaaagagaggctgaagaaactcaagaaatatgctgaaccaatccccggtaagcctcagcttgccgacaagtgggatgactacgcgtccgatttcggcgggaaactggagtcatggtatagcaaccggatagagaagttgaaaaagattccagaaagtgtgtctgacctacgaaataacctggagaaaatccgcaatgttctcaagaaacagaacaatgcatccaagatcctggaacttagccagaagattatcgagtacattagagattatggagtgtcgtttgaaaaacccgagataatcaagttctcttggattaacaaaactaaggacggccagaaaaaggtcttttacgtggccaagatggctgatagggagttcatcgaaaaactggacttgtggatggccgatctccggtcccaactgaatgagtacaaccaggacaacaaggtatcatttaaaaagaaaggtaagaagatcgaagagttaggggttctggacttcgcactaaataaagctaagaaaaacaagagtaccaaaaatgagaacggatggcaacagaagctcagcgaatccattcagtctgcccctctgtttttcggcgagggcaatcgcgtgagaaacgaagaggtctataatcttaaggatttgctgttcagcgaaattaaaaacgtggagaatatcctcatgtcaagtgaggcggaagacctgaagaacattaaaatcgagtacaaggaagatggggccaaaaagggaaattatgtgcttaacgtcctggcaaggttttacgctcgtttcaatgaggacggttatggcgggtggaacaaagttaagacagtgttggaaaatattgcccgggaggctggaactgatttttccaagtacggcaacaacaataaccgaaatgccggtagattctatctcaacgggagggagcgccaggtatttaccctgatcaaattcgaaaagagcataacagtggagaaaatcttagaactggtcaagctaccatctctcctggacgaggcataccgggatcttgtgaatgaaaacaaaaatcacaagttgagagacgttattcaactgtcaaagaccatcatggccctcgtgctgagtcatagcgataaagagaagcagattggcggaaactacatccactccaaattatctggctataatgctctgatatcgaagagggactttattagccgctactccgtccagacgactaacgggacacagtgcaaacttgcgatcggaaagggtaagagtaaaaagggcaatgagattgatcgatatttctacgcatttcaattctttaaaaacgacgattcaaagatcaatttgaaagtgataaagaacaattctcacaagaacatcgacttcaacgacaatgaaaacaaaattaatgccctccaggtatatagctccaactaccagatccagtttctggattggttcttcgagaagcatcaagggaaaaagacctcactagaagttggaggcagctttactattgctgagaaatctctgacaatcgactggtccggtagtaatccgcgggtggggttcaagcgtagcgataccgaggaaaagagagtctttgtgtctcagcccttcacgctcatacctgacgatgaggacaaagaaaggcgcaaggagcggatgattaaaaccaagaacagatttatcggcatcgatattggagaatatggcctggcctggtcccttatcgaggtcgacaatggggataaaaacaataggggaatacgacagttggagtcaggtttcataacagacaaccagcaacaggtgctgaagaaaaatgttaagagttggcgccagaaccaaatccggcagacttttaccagcccagatacaaagattgcaagattaagggaatcgctcatcggctcctacaaaaatcagctggagtctcttatggtggccaagaaagctaacctgagcttcgaatacgaggtatcagggtttgaagtcggaggcaagcgtgtggccaaaatttatgacagtatcaagcgcggttccgttcggaagaaagacaataactctcagaatgatcaaagctgggggaagaaaggcataaacgagtggtccttcgagactaccgcagcgggaacatcacagttttgtacccactgcaagagatggagcagtttggctatcgtggacattgaagagtacgaactcaaagattataacgacaatctgttcaaggtcaagatcaacgatggcgaggtgaggctactggggaaaaagggatggcgatctggcgagaaaattaagggtaaagaactcttcgggcccgtaaaggacgccatgcggcctaatgtggatggactgggcatgaagatcgttaaacgcaagtaccttaaattggacctgagagattgggtctccaggtatggtaacatggcaatatttatttgtccatacgtggactgccatcacatcagccacgccgataagcaggctgccttcaatatcgcagtgcggggctatttaaaatcggtcaaccccgaccgagctattaagcatggggataaaggactctcaagagactttctgtgtcaggaggaaggcaaacttaatttcgagcaaatagggctgctatga

SEQ ID NO: 11366 - RNA, 3462 nt, synthetic construct
  misc_feature 1..3462: note = CasY variant__Candidatus Vogelbacteria bacterium__PIP58309.1__CasY
  source 1..3462: mol_type = other RNA
atgcagaaggtgagaaaaaccctgagcgaggtccacaagaacccctacggcacaaaagttaggaatgccaagactgggtattccctccaaatcgaacggctttcttacacgggaaaagagggtatgcgctcattcaagattcctctggaaaacaagaataaagaggtgtttgacgagttcgtaaagaaaatacgaaacgattatatcagtcaggtgggcttgttaaatctgagcgactggtacgaacattatcaggagaagcaggaacactactccctagctgatttttggctcgactctctgcgtgcaggggtcattttcgcccataaagagaccgaaatcaagaaccttatttcgaagatcagaggagataaatcaatagtggacaagtttaatgcgagcatcaaaaagaaacacgctgatctgtatgccttggttgacattaaggcactctacgatttcctgacaagtgacgccaggcggggcctgaaaactgaggaggaatttttcaactccaagcgcaataccctctttccaaagttcagaaagaaggataacaaagctgtggacttatgggtcaagaaatttatcggtctggataataaggacaaacttaacttcaccaaaaagtttattgggttcgacccgaatccccaaatcaaatacgatcatacattctttttccaccaggacataaactttgatttggagaggattactacacctaaggaactgatctctacctataaaaagttcctaggaaagaataaagacctctacggcagcgatgagacgactgaagaccagctgaagatggtgcttggctttcacaacaaccatggggcattctccaaatattttaatgcctcactggaggctttccggggacgcgataacagtttggtagagcagattatcaataacagcccatactggaactctcaccgaaaggaactcgagaaaagaatcatttttctgcaagttcagtccaagaagataaaagaaaccgagttaggtaagccccatgaatatctggcctcattcggcgggaaatttgagagctgggtgagtaattacctcaggcaggaggaagaggtcaagcggcagcttttcggatatgaagagaataaaaagggccagaaaaagtttatcgtgggtaacaagcaagaactggacaaaattatccgtgggacagatgagtacgagataaaggcgatttctaaagaaactatcggattgacccagaagtgcctaaaactgctcgagcaactgaaggactccgtggatgactacacacttagcctgtatcgccagttgatcgtcgaactcagaattaggctgaatgttgagttccaggagacctaccctgaattaatcggcaagtcggagaaagacaaggaaaaagatgcaaagaacaaacgggccgacaagcgatatccacagattttcaaggatataaaactgatccccaattttctaggcgagacgaagcaaatggtgtacaaaaagttcattcgctctgctgacatcctctatgaagggatcaactttattgatcagatagacaaacagatcactcagaatctgcttccttgtttcaagaacgataaggagagaattgagtttacagaaaaacaattcgagaccttgaggcggaagtactatctgatgaactcctcacgctttcaccacgtaatcgaaggaattatcaataacagaaaactcatagagatgaagaaaagggaaaatagtgagctgaagactttcagcgactccaaatttgtgctttctaagctgttcttgaagaaaggtaagaaatacgagaacgaagtctactatacattttacatcaatccaaaggcccgtgatcagcggcgaattaaaatcgtgctcgacattaacggcaataacagcgttgggatcctgcaggatttagtgcagaagctgaagccgaaatgggacgatataattaagaaaaatgacatgggagagctaatcgacgcaattgaaatcgagaaggtcagactcggcatactgatcgctctttattgcgaacataaattcaagattaagaaagagttgctgtcactcgatctgtttgccagtgcgtaccaatatttagagctggaagacgatcccgaggaactttccggtaccaacttggggaggttcctccagagcctggtgtgttctgagatcaagggcgccattaataaaatctcacgcacggagtacatagaacggtataccgtacagcctatgaacacagagaagaattacccactactgattaacaaagaaggaaaggcaacttggcacatcgctgccaaggacgatctcagtaaaaagaaaggcgggggaaccgttgctatgaatcagaagatcggtaaaaacttctttggcaagcaagactacaagacagtgttcatgctgcaggataaaagatttgaccttttgactagcaagtatcatctgcagttcttatccaaaaccctcgatacagggggaggctcttggtggaagaataaaaacattgacctgaacctttcgagctactcctttatcttcgagcaaaaggtcaaagtggaatgggatctgaccaatttggaccaccccattaagataaagccttcagagaacagtgatgacaggcgcctctttgtctctatcccattcgtgattaaacccaagcagactaaacgaaaggacctgcagacgcgggttaattatatgggtatcgatattggggagtacggcctagcctggacaatcataaacatcgacctgaaaaataagaagattaacaaaatcagcaagcagggatttatttatgaaccgctcacccataaagtgcgtgattacgtagcaactatcaaggacaatcaagtcagaggcaccttcgggatgcctgatacaaaactggccaggcttcgcgagaacgctataacctccttgcggaatcaggtgcacgacattgcgatgagatatgatgcaaagcccgtttacgaatttgagatctcaaacttcgaaactggaagcaataaggtgaaagtcatctacgactctgtgaagagggccgatattggtcgaggccagaacaatacagaggctgacaacacggaggtaaatctggtgtgggggaaaacctccaagcagttcggaagtcaaataggcgcctatgcaactagctacatctgctctttttgtggttattccccatactatgagttcgaaaactcaaaaagtggggatgaagagggcgcccgcgacaacttataccagatgaagaagctcagccggccttcgctggaagactttcttcagggaaatcccgtttataaaacattcagagattttgacaagtacaaaaacgatcagaggctgcaaaagaccggcgacaaagatggggagtggaagacacaccgtggaaatactgctatttacgcctgccagaaatgttga

SEQ ID NO: 11367 - RNA, 3480 nt, synthetic construct
  misc_feature 1..3480: note = Cas13a variant__Leptotrichia buccalis__WP_015770004.1__Cas13a
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaagtacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctgagaaaactcctgagctacgatcgcaagctgaaaaacgccgtgatgaagtctgtcgtggacatccttaaagaatatggcttcgtggccacattcaagattggggctgataagaaaatcggcattcagaccctggagtccgaaaagatcgttcacctcaaaaatctgaagaaaaagaagctcatgaccgacagaaacagcgaggagctgtgcaaacttgtcaagatcatgtttgaatacaaaatggaggaaaagaaatctgagaactga

SEQ ID NO: 11368 - RNA, 3480 nt, synthetic construct
  misc_feature 1..3480: note = Cas13a variant__Leptotrichia buccalis__WP_015770004.1__Cas13a(R472A,H477A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattgctcatgggatcgtcgccttcaatctggagctcgaaggaaaggatatctttgcgttcaaaaacattgccccgagcgagatctccaagaaaatgtttcagaatgaaattaacgagaagaagctgaaacttaagatcttccggcaactcaattctgctaacgtgtttagatacctggagaaatataagattctgaattacctgaaacgcacccggttcgaatttgttaacaagaatatccccttcgtgcctagctttacaaaactctattccagaatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcgcaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggccaataacggacggctttctctgatctacattggctccgatgaagagaccaatacaagcctcgctgaaaagaaacaagagttcgacaagtttctgaaaaagtatgaacagaacaataacatcaagattccctacgagatcaatgagttcctgagagaaattaaacttgggaacatcctcaagtatacggagcgcctgaatatgttttacctgatcctcaaactgcttaaccacaaggaactgaccaacctcaaaggatccctggagaagtatcagtctgcgaataaggaagaggccttcagcgatcagctggagcttattaacctcctgaatctggacaacaatcgggtcacagaagattttgagctcgaagctgacgagatcggcaaattcctggacttcaacgggaataaggtgaaagataacaaggagcttaaaaagtttgacaccaataaaatttacttcgatggagaaaacatcattaagcatagagccttttataatatcaagaaatacggcatgctgaacctcctggagaagatcgccgacaaagctggctacaagatttccatcgaggaactgaaaaagtattctaataagaaaaacgaaattgagaagaatcacaaaatgcaagagaaccttcaccgcaagtacgcccggcctagaaaagatgaaaagttcacagacgaggattatgaaagctacaagcaggcgatcgagaacattgaagagtatacccatctcaaaaataaggtcgagtttaacgaactgaatctgctccaggggctgcttctgcggatcctccaccgcctggtgggatacacgtccatctgggagagagacctgcggttcagacttaaaggcgaatttccggagaaccagtatattgaagagatcttcaattttgagaacaagaaaaatgttaagtacaaagggggacaaattgtggaaaagtacatcaagttctataaagagctgcatcagaacgatgaagtcaagattaataaatacagctctgctaacatcaaggtgctcaaacaggagaagaaggacctgtatattcgcaattacatcgcccactttaactatatcccccacgccgagatttccctcctggaagttcttgagaatctgcggaaactcctgagctacgatagaaagctgaaaaacgctgtgatgaagtctgtcgtggacatccttaaagaatatggcttcgtggccacattcaagattggggctgataagaaaatcggcattcagaccctggagtccgaaaagatcgttcatctcaaaaatctgaagaaaaagaagctcatgaccgaccgcaacagcgaggagctgtgcaaacttgtcaagatcatgtttgaatacaaaatggaggaaaagaaatctgagaactga

SEQ ID NO: 11369 - RNA, 3480 nt, synthetic construct
  misc_feature 1..3480: note = Cas13a variant__Leptotrichia buccalis__WP_015770004.1__Cas13a(R1048A,H1053A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaagtacatcaagttctataaagagctgcaccagaacgatgaagtcaagattaataaatacagctctgccaacatcaaggtgctcaaacaggagaagaaggacctgtatattgcgaattacatcgctgcctttaactatatcccccacgccgagatttccctcctggaagttcttgagaatctgcggaaactcctgagctacgatagaaagctgaaaaacgctgtgatgaagtctgtcgtggacatccttaaagaatatggcttcgtggccacattcaagattggggctgataagaaaatcggcattcagaccctggagtccgaaaagatcgttcatctcaaaaatctgaagaaaaagaagctcatgaccgaccgcaacagcgaggagctgtgcaaacttgtcaagatcatgtttgaatacaaaatggaggaaaagaaatctgagaactga

SEQ ID NO: 11370 - RNA, 3480 nt, synthetic construct
  misc_feature 1..3480: note = Cas13a variant__Leptotrichia buccalis__WP_015770004.1__Cas13a(R472A,H477A,R1048A,H1053A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattgctcatgggatcgtcgccttcaatctggagctcgaaggaaaggatatctttgcgttcaaaaacattgccccgagcgagatctccaagaaaatgtttcagaatgaaattaacgagaagaagctgaaacttaagatcttccggcaactcaattctgctaacgtgtttagatacctggagaaatataagattctgaattacctgaaacgcacccggttcgaatttgttaacaagaatatccccttcgtgcctagctttacaaaactctattccagaatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcgcaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggccaataacggacggctttctctgatctacattggctccgatgaagagaccaatacaagcctcgctgaaaagaaacaagagttcgacaagtttctgaaaaagtatgaacagaacaataacatcaagattccctacgagatcaatgagttcctgagagaaattaaacttgggaacatcctcaagtatacggagcgcctgaatatgttttacctgatcctcaaactgcttaaccacaaggaactgaccaacctcaaaggatccctggagaagtatcagtctgcgaataaggaagaggccttcagcgatcagctggagcttattaacctcctgaatctggacaacaatcgggtcacagaagattttgagctcgaagctgacgagatcggcaaattcctggacttcaacgggaataaggtgaaagataacaaggagcttaaaaagtttgacaccaataaaatttacttcgatggagaaaacatcattaagcatagagccttttataatatcaagaaatacggcatgctgaacctcctggagaagatcgccgacaaagctggctacaagatttccatcgaggaactgaaaaagtattctaataagaaaaacgaaattgagaagaatcacaaaatgcaagagaaccttcaccgcaagtacgcccggcctagaaaagatgaaaagttcacagacgaggattatgaaagctacaagcaggcgatcgagaacattgaagagtatacccatctcaaaaataaggtcgagtttaacgaactgaatctgctccaggggctgcttctgcggatcctccaccgcctggtgggatacacgtccatctgggagagagacctgcggttcagacttaaaggcgaatttccggagaaccagtatattgaagagatcttcaattttgagaacaagaaaaatgttaagtacaaagggggacaaattgtggaaaagtacatcaagttctataaagagctgcatcagaacgatgaagtcaagattaataaatacagctctgctaacatcaaggtgctcaaacaggagaagaaggacctgtatattgccaattacatcgccgcttttaactatatcccccacgccgagatttccctcctggaagttcttgagaatctgcgcaaactcctgagctacgatcggaagctgaaaaacgctgtgatgaagtctgtcgtggacatccttaaagaatatggcttcgtggccacattcaagattggggcggataagaaaatcggcattcagaccctggagtccgaaaagatcgttcacctcaaaaatctgaagaaaaagaagctcatgaccgacagaaacagcgaggagctgtgcaaacttgtcaagatcatgtttgaatacaaaatggaggaaaagaaatctgagaactga

SEQ ID NO: 11371 - RNA, 3480 nt, synthetic construct
  misc_feature 1..3480: note = Cas13a variant__Leptotrichia buccalis__WP_015770004.1__Cas13a(R1079A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaagtacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctgagaaaactcctgagctacgatgccaagctgaaaaacgccgtgatgaagtctgtcgtggacatccttaaagaatatggcttcgtggctacattcaagattggggccgataagaaaatcggcattcagaccctggagtccgaaaagatcgttcacctcaaaaatctgaagaaaaagaagctcatgaccgaccgcaacagcgaggagctgtgcaaacttgtcaagatcatgtttgaatacaaaatggaggaaaagaaatctgagaactga

SEQ ID NO: 11372 - RNA, 3480 nt, synthetic construct
  misc_feature 1..3480: note = Cas13a variant__Leptotrichia buccalis__WP_015770004.1__Cas13a(E299A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgctatgtcccagctgcttaagaattatgtctacaaacggctgagcaacatctccaatgataagattaagcgcatctttgagtatcaaaacctcaaaaagctgattgagaacaaacttctgaataagctcgacacatacgttagaaactgtgggaaatataattactatctgcaggatggagaaatcgccacctctgacttcattgcgcggaaccgccagaatgaggcctttctgagaaacatcatcggcgtgagctccgtggcttacttcagcctccggaatattctggaaacggagaacgaaaatgatatcaccggcagaatgcgcgggaagacagtcaagaacaataaaggagaggagaagtacgtgtctggcgaagttgacaaaatttataacgagaataagaaaaacgaagtgaaggagaatcttaagatgttctactcctatgattttaacatggacaacaaaaatgaaatcgaggatttctttgccaacattgacgaggctatcagctctattcggcatgggatcgtccacttcaatctggaactcgagggaaaggatatctttgccttcaaaaacattgcgccgagcgaaatctccaagaaaatgtttcagaatgagattaacgaaaagaagctgaaacttaagatcttcagacaactcaattctgccaacgtgtttcgctacctggagaaatataagattctgaattacctgaaacggaccagattcgagtttgttaacaagaatatccccttcgtgcctagctttacaaaactctattcccgcatcgacgacctgaagaacagccttggcatttactggaagacccccaaaacgaatgatgacaacaagacaaaagaaatcattgatgctcagatctacctgctcaagaatatttattacggggagttcctgaactatttcatgtctaacaatggaaactttttcgaaatctccaaagagatcattgagctgaataagaacgacaagcggaatcttaaaaccggcttttacaagctccagaaattcgaagatatccaggagaagattcctaaagaatatctggccaacatccaaagcctgtacatgattaatgctggcaaccaggacgaggaagagaaggatacatatatcgactttatccagaagattttcctcaaagggtttatgacctacctggccaataacggaagactttctctgatctacattggctccgatgaggaaaccaatacaagcctcgccgagaagaaacaagagttcgacaagtttctgaaaaagtatgagcagaacaataacatcaagattccctacgaaatcaatgagttcctgcgcgagattaaacttgggaacatcctcaagtatacggaacggctgaatatgttttacctgatcctcaaactgcttaaccataaggagctgaccaacctcaaaggatccctggaaaagtatcagtctgctaataaggaggaagcgttcagcgatcagctggagcttattaacctcctgaatctggacaacaatagagtcacagaggattttgaactcgaggccgacgaaatcggcaaattcctggacttcaacgggaataaggtgaaagataacaaggagcttaaaaagtttgacaccaataaaatttacttcgatggagagaacatcattaagcaccgcgctttttataatatcaagaaatacggcatgctgaacctcctggaaaagatcgccgacaaagccggctacaagatttccatcgaggaactgaaaaagtattctaataagaaaaacgagattgaaaagaatcacaaaatgcaagagaaccttcatcggaagtacgctagacctcggaaagatgagaagttcacagacgaagattatgagagctacaagcaggccatcgaaaacattgaggaatatacccacctcaaaaataaggtcgagtttaacgagctgaatctgctccaggggctgcttctgcgcatcctccatagactggtgggatacacgtccatctgggaacgggacctgagattccgccttaaaggcgagtttccggaaaaccagtatattgaggaaatcttcaattttgagaacaagaaaaatgttaagtacaaagggggacaaattgtggagaagtacatcaagttctataaagaactgcaccagaacgatgaggtcaagattaataaatacagctctgcgaacatcaaggtgctcaaacaggaaaagaaggacctgtatattcggaattacatcgctcactttaactatatcccccatgccgagatttccctcctggaggttcttgaaaatctgagaaaactcctgagctacgatcgcaagctgaaaaacgccgtgatgaagtctgtcgtggacatccttaaagagtatggcttcgtggctacattcaagattggggccgataagaaaatcggcattcagaccctggaatccgagaagatcgttcacctcaaaaatctgaagaaaaagaagctcatgaccgacagaaacagcgaggaactgtgcaaacttgtcaagatcatgtttgagtacaaaatggaagagaagaaatctgaaaactga

SEQ ID NO: 11373 - RNA, 3480 nt, synthetic construct
  misc_feature 1..3480: note = Cas13a variant__Leptotrichia buccalis__WP_015770004.1__Cas13a(K310A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaggaactcaatgacaagaacattaaatacgccttttgccacttcgtggaaatcgagatgtcccagctgcttaagaattatgtctacgctcggctgagcaacatctccaatgataaaattaagcgcatctttgagtatcaaaacctcaagaaactgattgaaaacaagctgctgaataaactcgacacatacgttagaaactgtgggaagtataattactatctgcaggatggagagatcgccacctctgacttcattgcgcggaaccgccagaatgaagcctttctgagaaacatcatcggcgtgagctccgtggcttacttcagcctccggaatattctggagacggaaaacgagaatgatatcaccggcagaatgcgcgggaaaacagtcaagaacaataagggagaggaaaaatacgtgtctggcgaggttgacaagatttataacgaaaataaaaagaacgaggtgaaagaaaatcttaagatgttctactcctatgattttaacatggacaacaagaatgagatcgaggatttctttgccaacattgacgaagctatcagctctattcggcatgggatcgtccacttcaatctggagctcgaaggaaaagatatctttgccttcaagaacattgcgccgagcgagatctccaaaaagatgtttcagaatgaaattaacgagaaaaagctgaaacttaaaatcttcagacaacttaattctgccaacgtgtttcgctacctcgagaagtataaaattctgaattacctgaagcggaccagattcgaatttgttaacaaaaatatccccttcgtgcctagctttacaaagctctattcccgcatcgacgacctgaaaaacagccttggcatttactggaagacccccaagacgaatgatgacaacaaaacaaaggagatcattgatgctcagatctacctgctcaaaaatatttattacggggagttcctgaactatttcatgtctaacaatggaaactttttcgaaatctccaaggagatcattgaactgaataaaaacgacaagcggaatcttaagaccggcttttacaaactccagaagttcgaggatatccaggaaaagattcctaaggagtatctggccaacatccaaagcctgtacatgattaatgctggcaaccaggacgaagaggagaaagatacatatatcgactttatccagaagattttcctcaaggggtttatgacctacctggccaataacggaagactttctctgatctacattggctccgatgaagagaccaatacaagcctcgccgaaaagaagcaagagttcgacaaatttctgaagaaatatgaacagaacaataacatcaagattccctacgagatcaatgagttcctgcgcgaaattaaacttgggaacatcctcaaatatacggagcggctgaatatgttttacctgatcctcaagctgcttaaccataaagaactgaccaacctcaagggatccctggagaaatatcagtctgctaataaggaagaggcgttcagcgatcagctggagcttattaacctcctgaatctggacaacaatagagtcacagaagattttgagctcgaagccgacgagatcggcaagttcctggacttcaacgggaataaagtgaaggataacaaagagcttaagaaatttgacaccaataagatttacttcgatggagaaaacatcattaaacaccgcgctttttataatatcaagaagtacggcatgctgaacctcctggagaaaatcgccgacaaggccggctacaaaatttccatcgaggaactgaagaaatattctaataagaagaacgaaattgagaaaaatcacaagatgcaagagaaccttcatcggaaatacgctagacctcggaaggatgaaaaattcacagacgaggattatgaaagctacaagcaggccatcgagaacattgaagagtatacccacctcaagaataaagtcgagtttaacgaactgaatctgctccaggggctgcttctgcgcatcctccatagactggtgggatacacgtccatctgggagcgggacctgagattccgccttaagggcgaatttccggagaaccagtatattgaagagatcttcaattttgagaacaaaaagaatgttaaatacaaagggggacaaattgtggaaaagtacatcaaattctataaggagctgcaccagaacgatgaagtcaaaattaataagtacagctctgcgaacatcaaagtgctcaagcaggagaaaaaggacctgtatattcggaattacatcgctcactttaactatatcccccatgccgagatttccctcctggaagttcttgagaatctgagaaagctcctgagctacgatcgcaaactgaagaacgccgtgatgaaatctgtcgtggacatccttaaggaatatggcttcgtggctacattcaaaattggggccgataagaagatcggcattcagaccctggagtccgaaaagatcgttcacctcaagaatctgaaaaagaaaaagctcatgaccgacagaaacagcgaggagctgtgcaaacttgtcaaaatcatgtttgaatacaagatggaggaaaagaagtctgagaactga

SEQ ID NO: 11374 - RNA, 3480 nt, synthetic construct
  misc_feature 1..3480: note = Cas13a variant__Leptotrichia buccalis__WP_015770004.1__Cas13a(N314A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcgctatctccaacgataagattaagcgcatctttgagtatcaaaatctcaaaaagctgattgaaaacaaacttctgaacaagctcgacacatacgttagaaattgtgggaaatataactactatctgcaggatggagagatcgccacctctgacttcattgcgcggaatcgccagaacgaagcctttctgagaaatatcatcggcgtgagctccgtggcttacttcagcctccggaacattctggagacggaaaatgagaacgatatcaccggcagaatgcgcgggaagacagtcaagaataacaaaggagaggaaaagtacgtgtctggcgaggttgacaaaatttataatgaaaacaagaaaaatgaggtgaaggaaaaccttaagatgttctactcctatgattttaatatggacaacaaaaacgagatcgaggatttctttgccaatattgacgaagctatcagctctattcggcatgggatcgtccacttcaacctggagctcgaaggaaaggatatctttgccttcaaaaatattgcgccgagcgagatctccaagaaaatgtttcagaacgaaattaatgagaagaagctgaaacttaagatcttcagacaactgaactctgccaatgtgtttcgctacctcgagaaatataagattctgaactacctgaaacggaccagattcgaatttgttaataagaacatccccttcgtgcctagctttacaaaactctattcccgcatcgacgacctgaagaatagccttggcatttactggaagacccccaaaacgaacgatgacaataagacaaaagagatcattgatgctcagatctacctgctcaagaacatttattacggggaatttctgaattatttcatgtctaacaacggaaatttcttcgagatctccaaagagatcattgaactgaacaagaatgacaagcggaaccttaaaaccggcttttacaagctccagaaattcgaggatatccaggaaaagattcctaaagagtatctggccaatatccaaagcctgtacatgattaacgctggcaatcaggacgaagaggagaaggatacatatatcgactttatccagaagattttcctcaaagggtttatgacctacctggccaacaatggaagactttctctgatctacattggctccgatgaagagaccaacacaagcctcgccgaaaagaaacaagagttcgacaagtttctgaaaaagtatgaacagaataacaatatcaagattccctacgagatcaacgagttcctgcgcgaaattaaacttgggaatatcctcaagtatacggagcggctgaacatgttttacctgatcctcaaactgcttaatcataaggaactgaccaacctcaaaggatccctggagaagtatcagtctgctaacaaggaagaggcgttcagcgatcagctggagcttattaatctcctgaacctggacaataacagagtcacagaagattttgagctcgaagccgacgagatcggcaaattcctggacttcaatgggaacaaggtgaaagataataaggagcttaaaaagtttgacaccaacaaaatttacttcgatggagaaaatatcattaagcaccgcgctttttataacatcaagaaatacggcatgctgaatctcctggagaagatcgccgacaaagccggctacaagatttccatcgaggagctgaaaaagtattctaacaagaaaaatgaaattgagaagaaccacaaaatgcaagagaatcttcatcggaagtacgctagacctcggaaagatgaaaagttcacagacgaggattatgaaagctacaagcaggccatcgagaacattgaagagtatacccacctcaaaaacaaggtcgagtttaatgaactgaacctgctccaggggctgcttctgcgcatcctccatagactggtgggatacacgtccatctgggagcgggacctgagattccgccttaaaggcgaatttccggagaatcagtatattgaagagatcttcaactttgagaataagaaaaacgttaagtacaaagggggacaaattgtggaaaagtacatcaagttctataaagagctgcaccagaatgatgaagtcaagattaacaaatacagctctgcgaatatcaaggtgctcaaacaggagaagaaggacctgtatattcggaactacatcgctcactttaattatatcccccatgccgagatttccctcctggaagttcttgagaacctgagaaaactcctgagctacgatcgcaagctgaaaaatgccgtgatgaagtctgtcgtggacatccttaaagaatatggcttcgtggctacattcaagattggggccgataagaaaatcggcattcagaccctggagtccgaaaagatcgttcacctcaaaaacctgaagaaaaagaagctcatgaccgacagaaatagcgaggagctgtgcaaacttgtcaagatcatgtttgaatacaaaatggaggaaaagaaatctgagaactga

SEQ ID NO: 11375 - RNA, 3480 nt, synthetic construct
  misc_feature 1..3480: note = Cas13a variant__Leptotrichia buccalis__WP_015770004.1__Cas13a(R1072A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaagtacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctggccaaactcctgagctacgatagaaagctgaaaaacgccgtgatgaagtctgtcgtggacatccttaaagaatatggcttcgtggctacattcaagattggggccgataagaaaatcggcattcagaccctggagtccgaaaagatcgttcacctcaaaaatctgaagaaaaagaagctcatgaccgaccgcaacagcgaggagctgtgcaaacttgtcaagatcatgtttgaatacaaaatggaggaaaagaaatctgagaactga

SEQ ID NO: 11376 - RNA, 3480 nt, synthetic construct
  misc_feature 1..3480: note = Cas13a variant__Leptotrichia buccalis__WP_015770004.1__Cas13a(D1078A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaagtacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctgagaaaactcctgagctacgcccgcaagctgaaaaacgccgtgatgaagtctgtcgtggatatccttaaagaatatggcttcgtggctacattcaagattggggccgacaagaaaatcggcattcagaccctggagtccgaaaagatcgttcacctcaaaaatctgaagaaaaagaagctcatgaccgatagaaacagcgaggagctgtgcaaacttgtcaagatcatgtttgaatacaaaatggaggaaaagaaatctgagaactga

SEQ ID NO: 11377 - RNA, 3480 nt, synthetic construct
  misc_feature 1..3480: note = Cas13a variant__Leptotrichia buccalis__WP_015770004.1__Cas13a(R1079A,K1080A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaaatacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctgagaaaactcctgagctacgatgccgccctgaagaacgctgtgatgaaatctgtcgtggacatccttaaggaatatggcttcgtggccacattcaaaattggggctgataagaagatcggcattcagaccctggagtccgaaaagatcgttcacctcaagaatctgaaaaagaaaaagctcatgaccgaccgcaacagcgaggagctgtgcaaacttgtcaaaatcatgtttgaatacaagatggaggaaaagaagtctgagaactga

SEQ ID NO: 11378 - RNA, 3480 nt, synthetic construct
  misc_feature 1..3480: note = Cas13a variant__Leptotrichia buccalis__WP_015770004.1__Cas13a(K1080A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaaatacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctgagaaaactcctgagctacgatcgcgccctgaagaacgccgtgatgaaatctgtcgtggacatccttaaggaatatggcttcgtggctacattcaaaattggggccgataagaagatcggcattcagaccctggagtccgaaaagatcgttcacctcaagaatctgaaaaagaaaaagctcatgaccgacagaaacagcgaggagctgtgcaaacttgtcaaaatcatgtttgaatacaagatggaggaaaagaagtctgagaactga

SEQ ID NO: 11379 - RNA, 3480 nt, synthetic construct
  misc_feature 1..3480: note = Cas13a variant__Leptotrichia buccalis__WP_015770004.1__Cas13a(K1082A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaaatacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctgagaaaactcctgagctacgatcgcaagctggccaacgccgtgatgaaatctgtcgtggacatccttaaggaatatggcttcgtggctacattcaaaattggggccgataagaagatcggcattcagaccctggagtccgaaaagatcgttcacctcaagaatctgaaaaagaaaaagctcatgaccgacagaaacagcgaggagctgtgcaaacttgtcaaaatcatgtttgaatacaagatggaggaaaagaagtctgagaactga

SEQ ID NO: 11380 - RNA, 3480 nt, synthetic construct
  misc_feature 1..3480: note = Cas13a variant__Leptotrichia buccalis__WP_015770004.1__Cas13a(K1087A)
  source 1..3480: mol_type = other RNA
atgaaggtgaccaaagtcggcgggatcagccacaagaaatacacatccgagggaagactggttaagtctgaaagcgaggaaaaccggacggacgagcgcctctccgccctgcttaatatgagactggatatgtatattaaaaacccctctagcaccgaaacaaaggagaatcagaagcggatcggcaaactcaagaaattcttttccaacaagatggtgtacctgaaagacaataccctttctctgaagaacgggaagaaagagaatattgatcgcgaatatagcgagacagacatcctcgaatccgatgtgagagacaagaaaaacttcgctgtcctgaagaaaatttacctgaatgagaacgtgaatagcgaggaactcgaggtttttcggaacgatatcaagaaaaagctgaataagatcaactctcttaaatattccttcgaaaagaataaagccaactaccaaaagattaacgagaataacatcgaaaaagtggagggaaagagcaagcgcaatattatctatgactactacagagagtctgcgaaacgggatgcttatgtctccaacgtgaaggaagcctttgacaaactgtacaaggaggaagatattgccaaactcgttctggagatcgaaaatcttaccaagctggagaagtataaaattcgcgagttctaccatgaaatcatcggcagaaagaacgacaaagagaattttgctaagattatctatgaagagattcagaacgtgaataacatgaaagaactcatcgagaaggtccctgatatgagcgagctgaagaaatctcaggtgttctacaagtattacctggacaaagaagaactcaatgacaagaacattaaatacgccttttgccacttcgtggaaatcgagatgtcccagctgcttaagaattatgtctacaaacggctgagcaacatctccaatgataagattaagcgcatctttgagtatcaaaacctcaaaaagctgattgaaaacaaacttctgaataagctcgacacatacgttagaaactgtgggaaatataattactatctgcaggatggagagatcgctacctctgacttcattgcccggaaccgccagaatgaagcgtttctgagaaacatcatcggcgtgagctccgtggcctacttcagcctccggaatattctggagacggaaaacgagaatgatatcaccggcagaatgcgcgggaagacagtcaagaacaataaaggagaggaaaagtacgtgtctggcgaggttgacaaaatttataacgaaaataagaaaaacgaggtgaaggaaaatcttaagatgttctactcctatgattttaacatggacaacaaaaatgagatcgaggatttctttgctaacattgacgaagccatcagctctattcggcatgggatcgtccacttcaatctggagctcgaaggaaaggatatctttgctttcaaaaacattgccccgagcgagatctccaagaaaatgtttcagaatgaaattaacgagaagaagctgaaacttaagatcttcagacaactcaattctgcgaacgtgtttcgctacctggagaaatataagattctgaattacctgaaacggaccagattcgaatttgttaacaagaatatccccttcgtgcctagctttacaaaactctattcccgcatcgacgacctgaagaacagccttggcatttactggaagacccccaaaacgaatgatgacaacaagacaaaagagatcattgatgcccagatctacctgctcaagaatatttattacggggagttcctgaactatttcatgtctaacaatggaaactttttcgagatctccaaagagatcattgaactgaataagaacgacaagcggaatcttaaaaccggcttttacaagctccagaaattcgaggatatccaggaaaagattcctaaagagtatctggctaacatccaaagcctgtacatgattaatgccggcaaccaggacgaagaggagaaggatacatatatcgactttatccagaagattttcctcaaagggtttatgacctacctggctaataacggaagactttctctgatctacattggctccgatgaagagaccaatacaagcctcgccgaaaagaaacaagagttcgacaagtttctgaaaaagtatgaacagaacaataacatcaagattccctacgagatcaatgagttcctgcgcgaaattaaacttgggaacatcctcaagtatacggagcggctgaatatgttttacctgatcctcaaactgcttaaccataaggaactgaccaacctcaaaggatccctggagaagtatcagtctgccaataaggaagaggctttcagcgatcagctggagcttattaacctcctgaatctggacaacaatagagtcacagaagattttgagctcgaagcggacgagatcggcaaattcctggacttcaacgggaataaggtgaaagataacaaggagcttaaaaagtttgacaccaataaaatttacttcgatggagaaaacatcattaagcaccgcgccttttataatatcaagaaatacggcatgctgaacctcctggagaagatcgctgacaaagccggctacaagatttccatcgaggaactgaaaaagtattctaataagaaaaacgaaattgagaagaatcacaaaatgcaagagaaccttcatcggaagtacgccagacctcggaaagatgaaaagttcacagacgaggattatgaaagctacaagcaggctatcgagaacattgaagagtatacccacctcaaaaataaggtcgagtttaacgaactgaatctgctccaggggctgcttctgcgcatcctccatagactggtgggatacacgtccatctgggagcgggacctgagattccgccttaaaggcgaatttccggagaaccagtatattgaagagatcttcaattttgagaacaagaaaaatgttaagtacaaagggggacaaattgtggaaaaatacatcaagttctataaagagctgcaccagaacgatgaagtcaagattaataaatacagctctgccaacatcaaggtgctcaaacaggagaagaaggacctgtatattcggaattacatcgcgcactttaactatatcccccatgctgagatttccctcctggaagttcttgagaatctgagaaaactcctgagctacgatcgcaagctgaaaaacgccgtgatggcctctgtcgtggacatccttaaggaatatggcttcgtggctacattcaaaattggggccgataagaagatcggcattcagaccctggagtccgaaaagatcgttcacctcaagaatctgaaaaagaaaaagctcatgaccgacagaaacagcgaggagctgtgcaaacttgtcaaaatcatgtttgaatacaagatggaggaaaagaagtctgagaactga

SEQ ID NO: 11381 - RNA, 4170 nt, synthetic construct
  misc_feature 1..4170: note = Cas13a variant__Leptotrichia shahii__WP_018451595.1__Cas13a
  source 1..4170: mol_type = other RNA
atgggcaacctgttcgggcacaagagatggtacgaggtgcgggacaaaaaggattttaaaatcaagcgcaaagtcaaggttaagagaaattatgacggaaacaaatacattctcaatatcaacgaaaataacaataaggagaaaattgataacaataagttcatccggaaatatattaactacaagaagaatgacaacatcctgaaagaatttacccgcaagttccatgccggcaatatcctttttaaactgaaggggaaagagggaattatcagaattgaaaacaatgatgacttcctcgagacagaggaagtggtgctgtatatcgaggcttacggcaagagcgaaaaacttaaggccctggggattacgaagaaaaagatcattgatgaggcgatccggcagggaatcaccaaagacgataagaaaattgagatcaagcgccaagaaaacgaggaagagattgaaatcgacattagagatgagtatacaaacaagaccctcaatgactgctccatcatcctgcggattatcgagaacgatgaactggagaccaaaaagtctatttacgaaatctttaaaaatattaacatgagcctctacaagatcatcgagaaaattatcgaaaatgagacagagaaggtcttcgaaaaccgctattacgaggaacacctgagagagaaacttctgaaagacgacaagattgatgtgatcctcacaaattttatggaaattcgggagaaaatcaagtccaacctggagattcttggcttcgttaaattttatctgaatgtgggcggggacaagaagaaatctaagaacaaaaagatgctcgtcgagaaaatcctgaatatcaacgtggatctgaccgttgaagacattgctgatttcgtgatcaaggaactcgagttttggaatattacgaaacgcatcgagaaggtcaagaaagtgaacaatgagttcctggaaaagagacggaaccgcacctacattaaaagctatgtgcttctggacaagcatgaaaaattcaagatcgagagagaaaacaagaaagataagatcgtcaaatttttcgttgagaatattaagaacaattccatcaaagagaagattgaaaagatcctcgccgagtttaaaattgacgaactgatcaagaaacttgagaaggaactgaaaaagggaaactgtgatacagagatcttcggcatttttaagaaacactacaaggtgaatttcgactctaaaaagtttagcaaaaagtccgatgaggaaaaagagctctataagatcatttaccggtacctgaaggggagaatcgagaaaattctggtgaacgaacagaaggtccgcctcaaaaagatggagaaaatcgaaatcgagaagattctgaatgaaagcatcctttctgagaagattctgaaacgggtgaagcagtataccctcgaacatatcatgtacctgggaaaacttagacacaacgacattgacatgacaaccgttaatacggatgacttctcccgcctgcacgccaaggaggagctcgatctggaactgatcacatttttcgctagcaccaacatggagctcaataaaatcttttctcgggaaaacattaataacgacgagaatatcgatttctttggcggggacagagaaaagaactatgtgctggataagaaaattcttaactccaagatcaaaattatccgcgacctggatttcattgacaataagaacaatatcacaaacaatttcatccggaaatttaccaagattggaaccaacgagagaaatcgcatcctccatgccattagcaaggagcgggatctgcagggcacacaagacgattacaacaaagtcatcaatattatccagaacctgaagatctctgacgaagaggtgtccaaagctcttaatctcgacgttgtgttcaaggataaaaagaacattatcacgaagattaatgacatcaaaattagcgaagagaacaataacgatatcaagtatctgccctccttttctaaagtcctgcctgaaattctcaacctgtacagaaataacccgaagaatgagcccttcgacaccatcgagacagagaaaatcgtgcttaacgccctgatttatgtcaataaggaactctacaaaaagctgatcctggaagatgaccttgaggaaaacgagagcaagaatatttttctccaggagctgaaaaagaccctgggcaacatcgatgaaattgacgagaatatcatcgaaaactactataaaaatgcgcagatttccgccagcaaggggaacaataaagctatcaagaagtaccagaaaaaggtgattgagtgctatatcggatacctccgcaaaaactatgaggaactgttcgatttttctgacttcaagatgaatattcaagagatcaaaaagcagatcaaggatattaacgacaataaaacatacgaacggatcaccgttaagacgtccgataaaacaattgtgatcaacgacgactttgagtatattatcagcattttcgcccttctgaactctaatgctgtcatcaacaagatcagaaatcggtttttcgccaccagcgtgtggctcaacacctccgaataccagaatattatcgatattctggacgagatcatgcaactgaacacacttcgcaatgagtgtattaccgaaaactggaatctcaacctggaggaatttatccagaaaatgaaggagatcgaaaaggatttcgacgatttcaaaattcagacaaagaaagagatctttaataactactatgaggacattaagaataacatcctgacggagttcaaagatgacattaatggctgcgatgttctcgaaaagaaactggaaaagatcgtgatctttgacgatgagaccaagttcgaaattgacaaaaagtctaacatccttcaagacgagcagagaaaactgagcaacattaataagaaagatctcaagaagaaagtcgaccagtacatcaaggataaagaccaggagattaagtccaaaatcctgtgtcggattatctttaacagcgatttcctgaagaagtataaaaaggaaatcgacaatcttattgaggatatggaatctgagaacgagaataaatttcaagaaatctactatcctaaggagagaaagaacgaactctacatttataagaagaatctgttcctgaacatcgggaatcccaactttgacaaaatttacggactcatctccaatgatatcaagatggcggacgccaaattcctgtttaacattgatggcaagaatatccgcaaaaacaagattagcgagatcgacgctattcttaaaaatctgaacgataagctcaacgggtactctaaggaatataaagagaagtacatcaaaaagctgaaagagaatgacgacttcttcgccaagaacatccagaataagaactataaatcctttgaaaaggattacaatcgggtgagcgagtataaaaagattagagacctggtggagttcaactaccttaataaaatcgaatcctatctgattgatatcaactggaagctcgctattcagatggcccgctttgaaagagacatgcactacatcgttaatggactgcgggagctcggcattatcaagctgtctggctacaacacagggatcagccgcgcctatcctaaaagaaatggatccgatggcttctacaccacaaccgcttattacaagtttttcgacgaggaatcttataaaaagtttgagaaaatttgctacgggttcggaatcgatcttagcgaaaactccgagattaataagcccgaaaacgagagcatccggaattatatttctcatttttacatcgtccgcaaccctttcgcggactactccatcgccgagcagattgatagagtgagcaacctgctctcttattccacgcggtacaataacagcacctatgcttctgtgtttgaagtcttcaagaaagacgtgaatctggattacgacgagctgaagaaaaagtttaaacttatcggcaacaatgatattctggaacgcctcatgaagccgaagaaagttagcgtgctggagctcgagtcctataacagcgactacatcaagaatctgattatcgaacttctgacaaaaatcgagaacaccaatgacacactctga

SEQ ID NO: 11382 - RNA, 4170 nt, synthetic construct; identical to SEQ ID NO: 11381
  misc_feature 1..4170: note = Cas13a variant__Leptotrichia shahii__WP_018451595.1__Cas13a
  source 1..4170: mol_type = other RNA

SEQ ID NO: 11383 - RNA, 4305 nt, synthetic construct
  misc_feature 1..4305: note = Cas13a variant__Leptotrichia shahii__WP_018451595.1__Cas13a(long)
  source 1..4305: mol_type = other RNA
atgggcaacctgttcgggcacaagagatggtacgaggtgcgggacaaaaaggattttaaaatcaagcgcaaagtcaaggttaagagaaattatgacggaaacaaatacattctcaatatcaacgaaaataacaataaggagaaaattgataacaataagttcatccggaaatatattaactacaagaagaatgacaacatcctgaaagaatttacccgcaagttccatgccggcaatatcctttttaaactgaaggggaaagagggaattatcagaattgaaaacaatgatgacttcctcgagacagaggaagtggtgctgtatatcgaggcttacggcaagagcgaaaaacttaaggccctggggattacgaagaaaaagatcattgatgaggcgatccggcagggaatcaccaaagacgataagaaaattgagatcaagcgccaagaaaacgaggaagagattgaaatcgacattagagatgagtatacaaacaagaccctcaatgactgctccatcatcctgcggattatcgagaacgatgaactggagaccaaaaagtctatttacgaaatctttaaaaatattaacatgagcctctacaagatcatcgagaaaattatcgaaaatgagacagagaaggtcttcgaaaaccgctattacgaggaacacctgagagagaaacttctgaaagacgacaagattgatgtgatcctcacaaattttatggaaattcgggagaaaatcaagtccaacctggagattcttggcttcgttaaattttatctgaatgtgggcggggacaagaagaaatctaagaacaaaaagatgctcgtcgagaaaatcctgaatatcaacgtggatctgaccgttgaagacattgctgatttcgtgatcaaggaactcgagttttggaatattacgaaacgcatcgagaaggtcaagaaagtgaacaatgagttcctggaaaagagacggaaccgcacctacattaaaagctatgtgcttctggacaagcatgaaaaattcaagatcgagagagaaaacaagaaagataagatcgtcaaatttttcgttgagaatattaagaacaattccatcaaagagaagattgaaaagatcctcgccgagtttaaaattgacgaactgatcaagaaacttgagaaggaactgaaaaagggaaactgtgatacagagatcttcggcatttttaagaaacactacaaggtgaatttcgactctaaaaagtttagcaaaaagtccgatgaggaaaaagagctctataagatcatttaccggtacctgaaggggagaatcgagaaaattctggtgaacgaacagaaggtccgcctcaaaaagatggagaaaatcgaaatcgagaagattctgaatgaaagcatcctttctgagaagattctgaaacgggtgaagcagtataccctcgaacatatcatgtacctgggaaaacttagacacaacgacattgacatgacaaccgttaatacggatgacttctcccgcctgcacgccaaggaggagctcgatctggaactgatcacatttttcgctagcaccaacatggagctcaataaaatcttttctcgggaaaacattaataacgacgagaatatcgatttctttggcggggacagagaaaagaactatgtgctggataagaaaattcttaactccaagatcaaaattatccgcgacctggatttcattgacaataagaacaatatcacaaacaatttcatccggaaatttaccaagattggaaccaacgagagaaatcgcatcctccatgccattagcaaggagcgggatctgcagggcacacaagacgattacaacaaagtcatcaatattatccagaacctgaagatctctgacgaagaggtgtccaaagctcttaatctcgacgttgtgttcaaggataaaaagaacattatcacgaagattaatgacatcaaaattagcgaagagaacaataacgatatcaagtatctgccctccttttctaaagtcctgcctgaaattctcaacctgtacagaaataacccgaagaatgagcccttcgacaccatcgagacagagaaaatcgtgcttaacgccctgatttatgtcaataaggaactctacaaaaagctgatcctggaagatgaccttgaggaaaacgagagcaagaatatttttctccaggagctgaaaaagaccctgggcaacatcgatgaaattgacgagaatatcatcgaaaactactataaaaatgcgcagatttccgccagcaaggggaacaataaagctatcaagaagtaccagaaaaaggtgattgagtgctatatcggatacctccgcaaaaactatgaggaactgttcgatttttctgacttcaagatgaatattcaagagatcaaaaagcagatcaaggatattaacgacaataaaacatacgaacggatcaccgttaagacgtccgataaaacaattgtgatcaacgacgactttgagtatattatcagcattttcgcccttctgaactctaatgctgtcatcaacaagatcagaaatcggtttttcgccaccagcgtgtggctcaacacctccgaataccagaatattatcgatattctggacgagatcatgcaactgaacacacttcgcaatgagtgtattaccgaaaactggaatctcaacctggaggaatttatccagaaaatgaaggagatcgaaaaggatttcgacgatttcaaaattcagacaaagaaagagatctttaataactactatgaggacattaagaataacatcctgacggagttcaaagatgacattaatggctgcgatgttctcgaaaagaaactggaaaagatcgtgatctttgacgatgagaccaagttcgaaattgacaaaaagtctaacatccttcaagacgagcagagaaaactgagcaacattaataagaaagatctcaagaagaaagtcgaccagtacatcaaggataaagaccaggagattaagtccaaaatcctgtgtcggattatctttaacagcgatttcctgaagaagtataaaaaggaaatcgacaatcttattgaggatatggaatctgagaacgagaataaatttcaagaaatctactatcctaaggagagaaagaacgaactctacatttataagaagaatctgttcctgaacatcgggaatcccaactttgacaaaatttacggactcatctccaatgatatcaagatggcggacgccaaattcctgtttaacattgatggcaagaatatccgcaaaaacaagattagcgagatcgacgctattcttaaaaatctgaacgataagctcaacgggtactctaaggaatataaagagaagtacatcaaaaagctgaaagagaatgacgacttcttcgccaagaacatccagaataagaactataaatcctttgaaaaggattacaatcgggtgagcgagtataaaaagattagagacctggtggagttcaactaccttaataaaatcgaatcctatctgattgatatcaactggaagctcgctattcagatggcccgctttgaaagagacatgcactacatcgttaatggactgcgggagctcggcattatcaagctgtctggctacaacacagggatcagccgcgcctatcctaaaagaaatggatccgatggcttctacaccacaaccgcttattacaagtttttcgacgaggaatcttataaaaagtttgagaaaatttgctacgggttcggaatcgatcttagcgaaaactccgagattaataagcccgaaaacgagagcatccggaattatatttctcatttttacatcgtccgcaaccctttcgcggactactccatcgccgagcagattgatagagtgagcaacctgctctcttattccacgcggtacaataacagcacctatgcttctgtgtttgaagtcttcaagaaagacgtgaatctggattacgacgagctgaagaaaaagtttaaacttatcggcaacaatgatattctggaacgcctcatgaagccgaagaaagttagcgtgctggagctcgagtcctataacagcgactacatcaagaatctgattatcgaacttctgacaaaaatcgagaacaccaatgacacactcaagagacccgccgccaccaaaaaggctgggcaagccaaaaagaagaaaggctcttatccttacgatgtccccgactacgcgtatccttacgatgtgcccgactatgcttacccgtatgatgttcctgactacgcctga

SEQ ID NO: 11384 - RNA, 4158 nt, synthetic construct
  misc_feature 1..4158: note = Cas13a variant__Leptotrichia sp. oral__WP_021744063.1__Cas13a
  source 1..4158: mol_type = other RNA
atgggcaacctgttcgggcacaagagatggtacgaggtgcgggacaaaaaggattttaaaatcaagcgcaaagtcaaggttaagagaaattatgacggaaacaaatacattctcaatatcaacgaaaataacaataaggagaaaattgataacaataagttcatcggcgaatttgtgaactataaaaagaataacaatgtgctgaaggagttcaaacggaagtttcatgccgggaacattcttttcaaactgaagggaaaagaagagatcatccgcattgagaataacgacgattttctcgaaaccgaggaagtcgtgctgtacatcgaggtttatggcaagagcgagaaacttaaggctctggaaattacaaagaaaaagatcattgacgaggccatcagacaggggattacgaaagatgacaagaaaatcgaaatcaagcggcaagagaacgaagaggagattgaaatcgatattcgcgacgagtacaccaataagacactcaacgattgctccatcattctgagaatcatcgaaaatgacgagctggaaaccaaaaagtctatttatgagatcttcaaaaacattaatatgagcctctacaagatcattgagaaaatcatcgaaaacgagacagaaaaggtgtttgagaatcggtactatgaggagcatctgcgcgagaaacttctgaaagataacaagattgacgtcatcctcaccaatttcatggaaattagagagaaaatcaagtccaacctggaaattatgggatttgtgaaattctaccttaatgtttctggcgacaagaagaaaagcgagaacaagaaaatgtttgtggagaagatcctgaatacaaacgtcgatctcaccgtggaagacattgtggatttcatcgtcaaagagctgaagttctggaatatcacgaaacggattgaaaaggttaagaaatttaacaacgagttcctggaaaatcgcagaaaccggacctatatcaagtcctacgtgctcctggacaaacacgagaagtttaaaattgagcgcgaaaataagaaggataaaatcgtgaagttctttgtcgagaacattaaaaataactctatcaaggaaaagatcgagaagattcttgcggaatttaagatcaatgagctgattaaaaagctcgagaaagaactgaagaaaggcaactgtgacacagagatctttgggattttcaagaagcactataaagtgaattttgatagcaagaaattctccaacaagagcgacgaagagaaagaactttacaagatcatctatagatacctgaaaggacggattgagaagatcctcgttaatgagcagaaggtgagactgaaaaagatggaaaagattgagatcgaaaagattctgaacgagtctatcctctccgagaaaatcctgaagcgcgtcaagcagtacacccttgaacatattatgtatctgggcaaactccggcacaatgatatcgtgaagatgacagttaacaccgacgattttagcagactgcacgctaaagaggaacttgacctggagctcattacgttctttgcctctacaaatatggaactgaacaagatcttcaacgggaaagagaaggtgaccgacttctttggattcaatctgaacggccagaagattacactcaaagagaaggtcccctcctttaaactgaatatccttaagaaactgaacttcattaataacgaaaataacatcgatgagaagctcagccatttttactctttccaaaaggaagggtatctgctgcgcaataaaatccttcacaactcctacggaaatattcaggagaccaagaacctcaaaggcgaatatgagaatgtggagaagctgatcaaagaactgaaggtcagcgacgaggaaatttccaagtctctcagcctggatgtgatctttgagggcaaagttgacattatcaacaagatcaattcccttaaaattggggaatacaaggataaaaagtatctgcctagcttctctaaaatcgtgctcgagattacccggaagtttagagagatcaacaaggacaaactgttcgatattgaatccgagaagatcatcctgaacgccgtcaaatacgtgaataagattctttacgagaaaatcacaagcaacgaagagaatgaatttctcaagacgctgccggacaagctggttaaaaagtctaacaataaaaaggagaacaaaaatctcctgagcattgaagagtattacaagaacgctcaggtgtcctctagcaagggagataaaaaggccatcaaaaagtatcagaataaagtcaccaacgcttaccttgaatatctggagaatacattcaccgagattatcgacttttccaagttcaacctcaattacgatgaaattaagacaaaaatcgaggaacgcaaggacaacaaaagcaagatcattatcgattctatttccaccaatatcaacattacgaatgacatcgagtatatcattagcatcttcgccctgctgaactctaacacatacattaataaaatccggaacagatttttcgcgacctccgtgtggcttgaaaagcaaaatggcaccaaagagtacgactatgagaacattatcagcatcctcgatgaagtgctgctgattaatctcctgcgcgagaacaatatcacagacattcttgatctgaagaacgccatcattgacgctaagatcgttgaaaatgatgagacctacattaaaaactatatctttgaatccaatgaggagaagctcaaaaagcggctgttctgcgaggaactggtcgacaaagaagatatcagaaagatttttgaggacgagaacttcaagtttaaatctttcatcaagaaaaatgaaattgggaactttaagatcaatttcggaatccttagcaacctcgagtgtaactccgaagtggaggccaaaaagattatcggcaaaaattctaaaaagctggagagctttattcagaacatcattgatgaatacaaatccaatatccgcacactgttcagctctgagttcctcgaaaagtataaagaggaaattgacaacctggtggaggatacggaatccgagaataagaacaagtttgagaaaatctactatcccaaggaacataaaaatgagctttacatctacaagaaaaacctgttcctcaatattgggaaccctaattttgacaagatctatggactgattagcaaagatatcaagaacgtcgacaccaagattctgttcgacgatgacatcaaaaagaataaaatttctgaaatcgatgctatccttaagaacctgaatgacaaactcaacggctactccaacgattataaggccaagtacgtgaataaactgaaggagaacgacgatttcttcgcgaaaaatattcagaacgaaaattatagctcttttggcgagttcgagaaggactacaacaaagttagcgaatataagaagatccgggatctcgtggagtttaattacctgaacaaaattgaatcctaccttatcgacattaattggaagctggccatccagatggctagattcgagcgggatatgcactatatcgtcaacgggctccgcgagctgggaattatcaaactgagcggctacaatacagggatttctagagcctatcccaagcggaacggatccgacggcttttacaccacaaccgcttattacaaattctttgacgaagagagctataagaagttcgagaaaatctgctacgggttcggcattgatctttccgaaaattctgaaatcaacaagcctgaaaatgagagcatcagaaactacatttcccacttttatatcgtgcgcaaccccttcgccgactactctattgccgaacaaatcgatcgggttagcaatctgctctcctattctacgagatacaacaatagcacctatgcttccgtgtttgaggtcttcaaaaaggacgtgaacctggattacgacgaactcaaaaagaagtttcgcctgattggaaataacgatatccttgagagactgatgaaacctaagaaagttagcgtgctcgaactggagtcttataattccgactacattaagaacctgatcatcgagcttctgacaaaaattgaaaataccaacgatacactctga

SEQ ID NO: 11385 - RNA, 3459 nt, synthetic construct
  misc_feature 1..3459: note = Cas13a variant__Leptotrichia wadei__WP_021746774.1__Cas13a
  source 1..3459: mol_type = other RNA
atgaaggtgaccaaagtcgacggcatcagccacaagaaatacattgaggaagggaagctggttaaatccacatctgaggaaaacagaacgagcgagcggctctccgaactgctttctatccgcctggatatttatatcaagaatcccgacaacgccagcgaggaggaaaatcggattagacgcgagaacctcaagaaattcttttccaataaggtgctgcatcttaaagattctgtgctgtacctcaagaacagaaaagaaaagaatgctgtccaggacaagaactatagcgaggaggatatctccgaatacgacctgaaaaataagaacagcttctctgtgctgaaaaagatcctcctgaatgaggatgttaactccgaggaacttgaaatttttcggaaagacgtggaggccaagctgaataaaatcaacagcctcaagtattctttcgaggaaaataaggcgaactaccaaaagattaacgagaataacgtcgaaaaggtgggaggcaaatccaagcgcaatatcatttatgattactacagagagagcgctaaacggaacgactatatcaataacgttcaggaagcctttgataagctgtacaagaaagaggacattgagaagctgttctttctgatcgaaaattctaaaaagcacgagaaatataagatccgcgaatactatcataagattatcgggagaaagaacgataaggagaatttcgccaaaattatctacgaagagattcagaacgtgaataacatcaaggagctcatcgaaaagattcctgacatgtccgagctgaaaaagagccaggtcttttataaatactacctggacaaggaggaactcaatgataaaaacatcaagtatgctttctgccactttgtggagattgaaatgtcccaactgcttaaaaattacgtgtataagcggctgtctaacatcagcaacgacaaaattaagcgcatcttcgagtaccagaatctcaagaaactgatcgaaaacaaacttctgaataaactcgatacctatgtcagaaactgtggaaagtacaattattacctgcaggttggcgagattgccacatccgactttatcgctcggaaccgccagaatgaagccttcctgagaaacattatcggggtgagctctgtggcgtacttctccctccggaatattctggagaccgagaacgaaaatggaatcacaggcagaatgcgcggcaaaaccgtcaagaacaataagggggaggaaaaatatgtgagcggagaggttgataagatttacaacgaaaataaacaaaacgaggtgaaggagaaccttaaaatgttttattcttacgacttcaatatggataacaagaatgaaatcgaggactttttcgccaacatcgatgaagctattagctccatccggcatggcattgtccactttaatctggagctcgaagggaaggacatcttcgcctttaaaaacattgctccgtctgagatcagcaagaaaatgttccagaatgagatcaacgaaaagaaactgaaacttaagatttttaaacagcttaattccgccaacgtgttcaattattacgagaaggatgttatcattaaatatctcaagaacacaaaatttaatttcgtgaacaagaatatcccctttgtccctagcttcaccaaactgtacaacaagattgaagacctgagaaacacgctcaagttcttttggtctgtgcccaaagacaaggaggagaaagatgcgcagatctacctgcttaagaatatctattacggagagttcctgaacaaatttgtcaaaaattccaaggtgttctttaaaattaccaacgaagttatcaagattaataaacaacgcaaccagaagacaggccactataaataccagaagttcgaaaatatcgagaagaccgtgcctgtcgaatatctcgccattatccaaagccgggagatgatcaacaatcaggacaaagaggaaaagaacacatacattgattttatccagcagattttcctgaaagggtttatcgactatctgaataagaacaatcttaaatacattgagtctaacaataacaatgataacaacgacatcttctccaagattaagatcaaaaaggataataaagaaaagtacgacaaaatcctcaagaactatgagaagcataatagaaacaaagaaattccccacgagatcaatgagtttgtgcgcgaaattaagctgggaaaaatcctgaagtacaccgagaacctcaatatgttctatctgattcttaaactgctcaaccataaggaactgacgaatctgaaaggcagccttgagaagtaccaatccgctaacaaggaagagacattttctgatgagctcgaactgatcaatctgctcaacctggacaataaccgggttaccgaggatttcgaacttgaggccaatgagatcggcaaattcctggactttaacgaaaacaagattaaagatagaaaggagctcaaaaagttcgacacaaataagatctattttgacggggaaaacattatcaaacaccgcgctttctacaatattaagaaatatggaatgctgaacctgcttgagaagatcgccgataaagccaagtacaagatcagcctcaaagaactgaaggagtactccaataaaaagaacgagattgaaaagaattataccatgcagcagaacctgcaccggaagtacgctagacctaagaaagacgagaagtttaatgatgaagactataaagagtacgaaaaggcgatcggcaacattcagaaatatacccatctcaagaataaagtggagttcaacgagctgaatcttctgcaagggctcctgctgaagatccttcaccgcctcgtcggatacacatctatttgggaacgggatctgagatttcggctgaagggcgagttcccggaaaaccattatatcgaggaaatttttaatttcgacaacagcaaaaacgtgaagtacaaatccgggcagatcgtggagaagtacatcaatttttataaagagctctacaaggataacgttgaaaagcgcagcatttattctgacaaaaaggtcaaaaagctgaaacaggagaagaaggatctttacatcagaaattatattgcccacttcaactacatcccccatgctgaaatttccctgctcgaggtgctggagaatctgcggaaacttctgagctatgacagaaagctcaaaaacgccatcatgaagtctatcgtggatattctgaaagaatacggattcgtcgccacgtttaagatcggcgctgacaagaaaattgagatccagaccctcgaatccgagaagattgtgcacctgaaaaatcttaagaaaaagaaactgatgacagatcgcaacagcgaggaactctgcgagctggttaaggtgatgttcgaatacaaggccctggagtga

SEQ ID NO: 11386 - RNA, 3459 nt, synthetic construct
  misc_feature 1..3459: note = Cas13a variant__Leptotrichia wadei__WP_021746774.1__Cas13a(G403D)
  source 1..3459: mol_type = other RNA
atgaaggtgaccaaagtcgacggcatcagccacaagaaatacattgaggaagggaagctggttaaatccacatctgaggaaaacagaacgagcgagcggctctccgaactgctttctatccgcctggatatttatatcaagaatcccgacaacgccagcgaggaggaaaatcggattagacgcgagaacctcaagaaattcttttccaataaggtgctgcatcttaaagattctgtgctgtacctcaagaacagaaaagaaaagaatgctgtccaggacaagaactatagcgaggaggatatctccgaatacgacctgaaaaataagaacagcttctctgtgctgaaaaagatcctcctgaatgaggatgttaactccgaggaacttgaaatttttcggaaagacgtggaggccaagctgaataaaatcaacagcctcaagtattctttcgaggaaaataaggcgaactaccaaaagattaacgagaataacgtcgaaaaggtgggaggcaaatccaagcgcaatatcatttatgattactacagagagagcgctaaacggaacgactatatcaataacgttcaggaagcctttgataagctgtacaagaaagaggacattgagaagctgttctttctgatcgaaaattctaaaaagcacgagaaatataagatccgcgaatactatcataagattatcgggagaaagaacgataaggagaatttcgccaaaattatctacgaagagattcagaacgtgaataacatcaaggagctcatcgaaaagattcctgacatgtccgagctgaaaaagagccaggtcttttataaatactacctggacaaggaggaactcaatgataaaaacatcaagtatgctttctgccactttgtggagattgaaatgtcccaactgcttaaaaattacgtgtataagcggctgtctaacatcagcaacgacaaaattaagcgcatcttcgagtaccagaatctcaagaaactgatcgaaaacaaacttctgaataaactcgatacctatgtcagaaactgtggaaagtacaattattacctgcaggttggcgagattgccacatccgactttatcgctcggaaccgccagaatgaagccttcctgagaaacattatcggggtgagctctgtggcgtacttctccctccggaatattctggagaccgagaacgaaaatgatatcacaggaagaatgcgcggcaaaaccgtcaagaacaataagggcgaggaaaaatatgtgagcggggaggttgacaagatttacaacgaaaataaacaaaacgaggtgaaggagaaccttaaaatgttttattcttacgatttcaatatggacaacaagaatgaaatcgaggactttttcgccaacatcgatgaagctattagctccatccggcatggaattgtccactttaatctggagctcgaaggcaaggatatcttcgcctttaaaaacattgctccgtctgagatcagcaagaaaatgttccagaatgagatcaacgaaaagaaactgaaacttaagatttttaaacagcttaattccgccaacgtgttcaattattacgagaaggacgttatcattaaatatctcaagaacacaaaatttaatttcgtgaacaagaatatcccctttgtccctagcttcaccaaactgtacaacaagattgaagacctgagaaacacgctcaagttcttttggtctgtgcccaaagataaggaggagaaagacgcgcagatctacctgcttaagaatatctattacggggagttcctgaacaaatttgtcaaaaattccaaggtgttctttaaaattaccaacgaagttatcaagattaataaacaacgcaaccagaagacaggacactataaataccagaagttcgaaaatatcgagaagaccgtgcctgtcgaatatctcgccattatccaaagccgggagatgatcaacaatcaggataaagaggaaaagaacacatacattgactttatccagcagattttcctgaaaggctttatcgattatctgaataagaacaatcttaaatacattgagtctaacaataacaatgacaacaacgatatcttctccaagattaagatcaaaaaggacaataaagaaaagtacgataaaatcctcaagaactatgagaagcataatagaaacaaagaaattccccacgagatcaatgagtttgtgcgcgaaattaagctggggaaaatcctgaagtacaccgagaacctcaatatgttctatctgattcttaaactgctcaaccataaggaactgacgaatctgaaaggaagccttgagaagtaccaatccgctaacaaggaagagacattttctgacgagctcgaactgatcaatctgctcaacctggataataaccgggttaccgaggacttcgaacttgaggccaatgagatcggcaaattcctggattttaacgaaaacaagattaaagacagaaaggagctcaaaaagttcgacacaaataagatctattttgatggcgaaaacattatcaaacaccgcgctttctacaatattaagaaatatgggatgctgaacctgcttgagaagatcgccgacaaagccaagtacaagatcagcctcaaagaactgaaggagtactccaataaaaagaacgagattgaaaagaattataccatgcagcagaacctgcaccggaagtacgctagacctaagaaagatgagaagtttaatgacgaagattataaagagtacgaaaaggcgatcggaaacattcagaaatatacccatctcaagaataaagtggagttcaacgagctgaatcttctgcaaggcctcctgctgaagatccttcaccgcctcgtcgggtacacatctatttgggaacgggacctgagatttcggctgaagggagagttcccggaaaaccattatatcgaggaaatttttaatttcgataacagcaaaaacgtgaagtacaaatccggccagatcgtggagaagtacatcaatttttataaagagctctacaaggacaacgttgaaaagcgcagcatttattctgataaaaaggtcaaaaagctgaaacaggagaagaaggacctttacatcagaaattatattgcccacttcaactacatcccccatgctgaaatttccctgctcgaggtgctggagaatctgcggaaacttctgagctatgatagaaagctcaaaaacgccatcatgaagtctatcgtggacattctgaaagaatacgggttcgtcgccacgtttaagatcggagctgataagaaaattgagatccagaccctcgaatccgagaagattgtgcacctgaaaaatcttaagaaaaagaaactgatgacagaccgcaacagcgaggaactctgcgagctggttaaggtgatgttcgaatacaaggccctggagtga

SEQ ID NO: 11387 - RNA, 3909 nt, synthetic construct
  misc_feature 1..3909: note = Cas13a variant__Leptotrichia wadei__WP_021746774.1__6xHis-Tag/Twin-Strep/SUMO_Cas13a(G40 3D)
  source 1..3909: mol_type = other RNA
atgggcagctcccaccatcaccatcaccattctagcgggctggtgcccagaggatcccacatggcctcttggagccaccctcagttcgagaagggcgggggatccggcgggggatctggcggcagcgcttggtcccatccgcaatttgaaaagatgagcgactctgaggtcaaccaggaagccaagcccgaggttaaacctgaagtgaagcccgagacccacatcaatctcaaagtgtccgatgggagctctgagattttctttaagatcaagaaaacaacgcctctgcggcgccttatggaagcgttcgctaagagacagggaaaagagatggactccctgcggtttctctacgatggcattcgcatccaggccgaccaaacccccgaagatctggacatggaggataacgacattatcgaggcccatagagaacagatcgggggaagcatgaaggtcacaaaagtggatggcatttctcacaagaagtatatcgaggaagggaaacttgttaagtccaccagcgaggaaaatcggacatccgagcgcctgtctgagctcctgagcattagactggacatctacattaaaaaccctgataatgcttccgaagaggaaaaccggatccgcagagagaatctcaagaaattctttagcaacaaggtgctgcaccttaaagactctgtcctgtatctcaagaatcggaaggaaaagaacgccgtgcaggataagaattactccgaggaggacattagcgaatatgacctgaaaaacaaaaattctttcagcgttcttaaaaagatcctgctcaacgaggatgtcaattccgaggaactggaaatctttcgcaaggacgtggaggctaaactgaacaagattaactctctcaaatacagcttcgaggaaaataaggccaactatcagaaaatcaatgagaacaatgtggaaaaggtgggaggcaagtccaaaagaaacattatctacgattactatcgggagagcgcgaagcgcaatgactacattaacaatgtccaagaggcctttgataaactgtataagaaagaagacatcgagaaacttttctttctgatcgaaaactctaagaaacatgagaagtacaaaattagagaatattaccacaagatcattggccggaaaaatgataaggagaacttcgctaaaatcatttatgaggaaatccagaatgttaacaatatcaaggagctcattgaaaagatcccggacatgtccgagctgaaaaagagccaggtgttctacaaatactatcttgataaggaggaactgaacgacaaaaacattaagtacgccttttgccatttcgtggagatcgaaatgtctcagctcctgaagaattatgtctacaaaagactgtccaacattagcaatgataagatcaaacgcatttttgagtatcaaaacctcaagaaactgatcgaaaataaacttctgaacaagctcgacacctacgtgcggaattgtgggaagtataactactacctgcaggttggagagatcgctacatccgacttcattgccagaaatcgccagaacgaagcgtttcttcggaatatcattggcgtgtctagcgtcgcctatttctccctgagaaacatcctcgagaccgagaatgaaaacgatattacggggcgcatgcggggaaagaccgtgaaaaataacaagggcgaggaaaaatacgtttctggggaggtggacaagatctataacgagaataagcaaaacgaagtcaaagagaatctgaagatgttttacagctatgatttcaacatggacaataaaaacgaaatcgaggactttttcgctaatattgatgaagccatctccagcattagacacggaatcgtgcattttaacctggagctcgagggcaaggatattttcgcttttaaaaatatcgccccctctgaaatctccaagaaaatgttccagaacgagattaatgaaaagaagctgaaacttaagatcttcaaacagctgaacagcgccaatgtctttaactactatgagaaggacgtgattatcaaatacctcaagaatacaaagttcaactttgttaacaaaaatattcctttcgtgccctcttttaccaagctgtacaacaaaatcgaagatctgcgcaatacacttaagttcttttggtccgtccctaaagacaaggaggagaaggatgctcagatctatctcctgaaaaacatttactatggcgagttcctgaataagtttgtgaaaaacagcaaggttttctttaaaatcaccaatgaagtgattaagatcaacaagcaacggaatcagaaaacggggcactacaagtatcagaaattcgaaaacattgagaagacagtccccgtggaatacctcgcgatcattcagtctagagagatgatcaataaccaagacaaagaggaaaagaatacctatatcgattttattcagcagatcttcctgaagggattcattgactaccttaacaaaaataacctgaagtacatcgagagcaataacaacaatgacaacaatgatatcttttccaaaattaagatcaaaaaggacaacaaagaaaagtatgataagattctcaaaaattacgagaagcacaaccgcaataaagagatcccgcatgaaattaacgagttcgtgcgggaaatcaagctgggcaaaattctgaagtatacagagaatcttaacatgttttacctcatcctgaagctgctcaatcacaaagaactgaccaaccttaaggggagcctggagaaatatcagtctgccaataaggaggaaaccttctccgacgagctcgaactgatcaacctgcttaatctcgataacaacagagttacagaggactttgaactggaggctaatgagattggaaaattcctggattttaacgaaaataagatcaaggaccggaaagagctcaagaaattcgatacgaacaagatttactttgacggcgaaaatatcattaaacatcgcgccttctataacatcaagaagtacgggatgctgaatcttctggagaaaattgccgataaggctaaatacaagatcagcctcaaagaactgaaggagtattccaacaaaaagaatgagatcgaaaagaactacaccatgcaacagaatctgcacagaaaatatgcccggcctaagaaagacgagaagtttaacgatgaagactacaaagagtatgagaaggcgattggcaatatccagaagtacacacaccttaaaaacaaggtcgagttcaatgaactcaacctgctgcagggactcctgcttaaaattctgcatagactcgtgggctatacctctatctgggaacgcgacctgcggttcagactgaagggggagtttcccgaaaaccactacattgaggagatcttcaattttgataacagcaaaaatgtgaagtacaagtccggacaaatcgtcgaaaaatatattaacttctacaaggagctttataaagacaatgtggaaaagcgctctatctacagcgataaaaaggttaagaaactgaagcaggagaaaaaggacctctatattagaaactacatcgctcattttaattatattcctcacgccgaaatctccctgctcgaggtgctggagaaccttcggaaactgctctcttacgatcgcaagctgaaaaatgccatcatgaaaagcattgtcgacatcctgaaggaatacggcttcgtggctacatttaagattggggccgataagaaaatcgagattcagacccttgaatccgagaagatcgttcatctgaaaaacctcaagaagaaaaagctgatgacggacagaaatagcgaggaactctgcgagctggtgaaagtcatgttcgaatataaggctcttgagtga

SEQ ID NO: 11388 - RNA, 3459 nt, synthetic construct
  misc_feature 1..3459: note = Cas13a variant__Leptotrichia wadei__WP_021746774.1__Cas13a(R474A,R1046A)
  source 1..3459: mol_type = other RNA
atgaaggtgaccaaagtcgacggcatcagccacaagaaatacattgaggaagggaagctggttaaatccacatctgaggaaaacagaacgagcgagcggctctccgaactgctttctatccgcctggatatttatatcaagaatcccgacaacgccagcgaggaggaaaatcggattagacgcgagaacctcaagaaattcttttccaataaggtgctgcatcttaaagattctgtgctgtacctcaagaacagaaaagaaaagaatgctgtccaggacaagaactatagcgaggaggatatctccgaatacgacctgaaaaataagaacagcttctctgtgctgaaaaagatcctcctgaatgaggatgttaactccgaggaacttgaaatttttcggaaagacgtggaggccaagctgaataaaatcaacagcctcaagtattctttcgaggaaaataaggcgaactaccaaaagattaacgagaataacgtcgaaaaggtgggaggcaaatccaagcgcaatatcatttatgattactacagagagagcgctaaacggaacgactatatcaataacgttcaggaagcctttgataagctgtacaagaaagaggacattgagaagctgttctttctgatcgaaaattctaaaaagcacgagaaatataagatccgcgaatactatcataagattatcgggagaaagaacgataaggagaatttcgccaaaattatctacgaagagattcagaacgtgaataacatcaaggagctcatcgaaaagattcctgacatgtccgagctgaaaaagagccaggtcttttataaatactacctggacaaggaggaactcaatgataaaaacatcaagtatgctttctgccactttgtggagattgaaatgtcccaactgcttaaaaattacgtgtataagcggctgtctaacatcagcaacgacaaaattaagcgcatcttcgagtaccagaatctcaagaaactgatcgaaaacaaacttctgaataaactcgatacctatgtcagaaactgtggaaagtacaattattacctgcaggttggcgagattgccacatccgactttatcgctcggaaccgccagaatgaagccttcctgagaaacattatcggggtgagctctgtggcgtacttctccctccggaatattctggagaccgagaacgaaaatggaatcacaggcagaatgcgcggcaaaaccgtcaagaacaataagggggaggaaaaatatgtgagcggagaggttgataagatttacaacgaaaataaacaaaacgaggtgaaggagaaccttaaaatgttttattcttacgacttcaatatggataacaagaatgaaatcgaggactttttcgccaacatcgatgaagctattagctccatcgcccatggcattgtccactttaatctggagctcgaagggaaggacatcttcgcttttaaaaacattgccccgtctgagatcagcaagaaaatgttccagaatgagatcaacgaaaagaaactgaaacttaagatttttaaacagcttaattccgcgaacgtgttcaattattacgagaaggatgttatcattaaatatctcaagaacacaaaatttaatttcgtgaacaagaatatcccctttgtccctagcttcaccaaactgtacaacaagattgaagacctgcggaacacgctcaagttcttttggtctgtgcccaaagacaaggaggagaaagatgcccagatctacctgcttaagaatatctattacggagagttcctgaacaaatttgtcaaaaattccaaggtgttctttaaaattaccaacgaagttatcaagattaataaacaaagaaaccagaagacaggccactataaataccagaagttcgaaaatatcgagaagaccgtgcctgtcgaatatctcgctattatccaaagccgcgagatgatcaacaatcaggacaaagaggaaaagaacacatacattgattttatccagcagattttcctgaaagggtttatcgactatctgaataagaacaatcttaaatacattgagtctaacaataacaatgataacaacgacatcttctccaagattaagatcaaaaaggataataaagaaaagtacgacaaaatcctcaagaactatgagaagcataatcggaacaaagaaattccccacgagatcaatgagtttgtgagagaaattaagctgggaaaaatcctgaagtacaccgagaacctcaatatgttctatctgattcttaaactgctcaaccataaggaactgacgaatctgaaaggcagccttgagaagtaccaatccgccaacaaggaagagacattttctgatgagctcgaactgatcaatctgctcaacctggacaataaccgcgttaccgaggatttcgaacttgaggctaatgagatcggcaaattcctggactttaacgaaaacaagattaaagatcggaaggagctcaaaaagttcgacacaaataagatctattttgacggggaaaacattatcaaacacagagccttctacaatattaagaaatatggaatgctgaacctgcttgagaagatcgccgataaagctaagtacaagatcagcctcaaagaactgaaggagtactccaataaaaagaacgagattgaaaagaattataccatgcagcagaacctgcaccgcaagtacgcgcggcctaagaaagacgagaagtttaatgatgaagactataaagagtacgaaaaggccatcggcaacattcagaaatatacccatctcaagaataaagtggagttcaacgagctgaatcttctgcaagggctcctgctgaagatccttcacagactcgtcggatacacatctatttgggaacgcgatctgcggtttagactgaagggcgagttcccggaaaaccattatatcgaggaaatttttaatttcgacaacagcaaaaacgtgaagtacaaatccgggcagatcgtggagaagtacatcaatttttataaagagctctacaaggataacgttgaaaagcggagcatttattctgacaaaaaggtcaaaaagctgaaacaggagaagaaggatctttacatcgctaattatattgcccacttcaactacatcccccatgccgaaatttccctgctcgaggtgctggagaatctgcgcaaacttctgagctatgacagaaagctcaaaaacgctatcatgaagtctatcgtggatattctgaaagaatacggattcgtcgccacgtttaagatcggcgcggacaagaaaattgagatccagaccctcgaatccgagaagattgtgcacctgaaaaatcttaagaaaaagaaactgatgacagatcggaacagcgaggaactctgcgagctggttaaggtgatgttcgaatacaaggctctggagtga

SEQ ID NO: 11389 - RNA, 5073 nt, synthetic construct
  misc_feature 1..5073: note = Cas13a variant__Leptotrichia wadei__WP_021746774.1__XY_Cas13a(R474A,R1046A)_EGFP_ZF-CCR5 T_KRAB -A _NLS
  source 1..5073: mol_type = other RNA
atgggcggggagggactgagagccagcccccggcgcagacctctcctgccgcttcagccccggggctgccctcgcggggacggatgtctgagaggcgggcggggacgcgctggcttcggcttttggagagtgaccgggggatcccgggcctctgcgaaccacgtccatgctttctttttctttctccaactgcttggcaatgttctggtgatcgtgctcagccaccatttcgggaaggaatttggaacagccggccccggggccacgatgaaagtcaccaaggtggatggaatttcccacaaaaagtacatcgaggaaggcaaactggttaagtctacaagcgaggaaaaccgcacctccgagagactgtctgagctcctgagcattcggcttgacatctatattaagaatcctgataacgcttccgaagaggaaaatcgcatcagacgggagaacctgaaaaagttctttagcaataaagtgctccatctgaaggactctgtcctttacctgaaaaaccgcaaggagaagaatgccgtgcaggataaaaactattccgaagaggacatcagcgaatacgatctcaagaataaaaactctttctccgttctgaagaaaattctgctcaatgaggacgtgaacagcgaggaactggagatctttagaaaggatgtcgaagctaaacttaataagattaactctctgaagtattccttcgaggaaaacaaagccaattaccagaagatcaacgagaataacgtggaaaaagtgggcggaaagagcaaacggaatattatctatgactactacagagagtccgcgaagcgcaacgattatattaataacgtccaggaggcctttgacaagctctacaaaaaggaagatatcgagaaactgttcttccttatcgaaaattctaagaaacacgagaagtataagattcgggaatactatcacaaaatcattgggagaaagaacgacaaagagaattttgctaagatcatttacgaggaaatccaaaacgttaataacatcaaagagctgattgaaaagatccccgacatgagcgagctcaagaaatcccaggtgttctataagtactacctggataaagaggaactgaatgacaagaacattaaatatgccttttgccatttcgtggagatcgaaatgagccagctcctgaagaactacgtctataaacgcctttctaatatttccaacgataagatcaagcggatctttgagtaccagaatctgaaaaagctcattgaaaacaaactgcttaataagctggacacatatgtgagaaactgtggcaaatacaattattacctccaagttggggagatcgctaccagcgatttcattgcccgcaaccggcagaatgaggcgtttctgagaaacatcattggagtgtctagcgtcgcctacttctccctgcgcaatatcctcgaaacagagaacgaaaatggcattaccgggcggatgagaggaaagacggtgaagaacaataaaggcgaggaaaagtatgtttctggcgaggtggacaaaatctacaacgagaacaagcagaatgaagtcaaagagaacctgaagatgttttatagctacgatttcaatatggacaacaagaatgaaatcgaggactttttcgctaacattgatgaagccatctccagcattgctcacgggatcgtgcattttaatcttgagctggagggaaaagatattttcgccttcaagaacatcgccccttctgaaatctccaaaaagatgtttcagaatgagattaacgaaaagaagctcaagctgaaaatcttcaagcaactgaatagcgctaacgtctttaattattacgagaaagacgtgattatcaagtatcttaaaaacaccaagttcaattttgttaacaaaaacattccgttcgtgccctcttttacaaagctctacaataagatcgaggacctgcgcaacaccctgaaattcttttggtccgtccctaaggataaagaagagaaggacgcgcagatctacctcctgaaaaatatttattacggcgagttccttaacaagtttgtgaagaatagcaaagttttctttaagatcacaaacgaagtgattaaaatcaataagcagcggaaccagaaaaccgggcactataagtaccaaaagttcgaaaatattgagaaaacggtccccgtggagtatctggccatcatccagtccagagaaatgattaacaatcaggataaggaggagaaaaacacatacatcgacttcattcaacagatctttctcaagggattcattgattatctgaataaaaacaatctgaagtacatcgaatctaacaataacaacgacaataacgatatttttagcaagatcaaaatcaagaaagacaataaggaaaaatacgataagattcttaagaactatgagaaacacaatcggaacaaggagatccctcatgaaattaatgagttcgtgcgcgaaatcaaactcggcaagattctgaaatacaccgagaacctgaatatgttttatctcatcctgaaacttctgaaccacaaagaactcacaaatctgaaggggtccctggagaagtaccagtctgctaacaaagaggaaaccttcagcgacgagcttgaactcatcaatctgctgaacctcgataataacagagttaccgaggactttgagctggaagccaacgagattggcaagttccttgattttaatgaaaacaaaatcaaggaccggaaagagctgaagaagttcgacacaaataaaatttattttgatggagaaaacatcattaagcatagagccttctacaatatcaaaaagtatggcatgctcaacctgctggagaaaatcgctgacaaggccaagtacaaaatttcccttaaggagctcaaagaatacagcaataagaaaaacgagatcgaaaagaattatacgatgcagcaaaacctgcaccgcaagtacgcgcggcccaaaaaggatgagaaattcaatgacgaagattataaggagtacgagaaagctattgggaacatccagaagtatacccatctgaaaaataaggtcgaatttaacgagctcaatctgcttcagggactgctcctgaagattctgcacagacttgtgggctacacatctatctgggaacgcgacctgagattccggctcaaaggggagtttccggaaaaccactatattgaggagatcttcaactttgataattccaagaacgtgaaatacaagagcggacagatcgtcgaaaaatacattaatttctataaggagctgtacaaggacaacgtggaaaaacgctctatctattccgataagaaagttaagaaactcaagcaagagaagaaagacctgtacattgccaattatatcgcccattttaactacattcctcacgctgagatcagccttctggaagtgctcgagaatctgagaaagctgctttcttatgatcggaaactgaagaacgccatcatgaaaagcattgtcgacatcctcaaggaatacggcttcgtggctacctttaagattggggccgataaaaagatcgagattcagacactggaatccgagaaaatcgttcatctcaagaatctgaaaaagaaaaagctgatgaccgaccgcaacagcgaggaactttgcgagctcgtgaaggtcatgttcgaatacaaagcgctggagggcggaggcgggtctggaggcgggggatccggcgggggcggaagcgtgtccaagggcgaggaactgtttacgggggttgtgcccatccttgtcgagctggacggagatgtgaatggccacaaattctctgtgagcggggaaggagagggcgacgccacatatgggaagctcaccctgaaatttatttgtaccacaggcaagctccctgtcccctggcccaccctggttacaacgcttacctacggagtgcagtgcttctccagatatcctgatcacatgaagcagcatgacttctttaaatctgctatgccggaaggctacgtgcaagagcggacaatcttctttaaggatgacgggaactataaaacccgcgccgaagtcaagttcgagggagatacactggtgaatagaattgagctgaaaggcatcgactttaaggaagatgggaacattctcggacacaagctggagtacaattataacagccataacgtttacatcatggctgacaaacagaagaatggcattaaagtgaacttcaagatccggcacaatatcgaagatggctccgtccagcttgccgaccattaccaacagaacacccccattggggacggacctgtgctgctccccgataatcactatctgtctacgcagagcgcgctctccaaagaccctaacgagaagcgcgatcacatggttctgcttgagtttgtgaccgccgctggcatcacactggggatggacgaactgtacagcagaggagccggcgctggggccggagccggcgctggctctcggttccagtgtagaatttgcatgcgcaatttttccgatcggagcaacctctctagacatatccgcacccacacaggggagaagcccttcgcgtgtgacatttgcggacggaaatttgccatctccagcaatctgaactctcataccaagatccacacgggctcccaaaaaccgttccagtgtagaatttgcatgcgcaattttagccggtccgataaccttgctagacatatccgcacacacaccggggaaaagcctttcgcctgcgacatttgtggacggaaattcgccacaagcggcaatctgaccagacacaccaagatccatctccgggggtctcagctgagcattgtcgatgctcccgagcagcgcgaaggagcctcccaagtgtctgttagcgtgacatttgaggacgtcgcggtcctcttcacgagagatgagtggaagaaactggacctttcccagcggtctctgtatcgcgaagtgatgctggagaactacagcaatctcgcttccatggccggctctcctaagaaaaagagaaaagtgtga

SEQ ID NO: 11390 - RNA, 3549 nt, synthetic construct
  misc_feature 1..3549: note = Cas13a variant__Leptotrichia wadei__ERK53440.1__Cas13a
  source 1..3549: mol_type = other RNA
atgtacatgaagatcaccaaaattgacggcgtgagccactataagaaacaggataaggggatcctgaaaaagaagtggaaagacctcgatgagagaaagcaacgggaaaagattgaggcccgctacaacaagcagatcgaatccaaaatttataaggagttctttagactgaagaataaaaagcggatcgaaaaagaggaggaccagaacatcaagtctctttacttctttattaaagaactgtatctcaatgagaagaacgaagagtgggagctgaaaaatatcaaccttgaaattctggatgacaaggagcgcgtcatcaagggatacaaattcaaggaagatgtttactttttcaaagagggctataaggaatactatctccggattctgtttaataacctgatcgagaaagtgcagaatgagaaccgggaaaaggtgcgcaagaataaagagttcctcgacctgaaggaaatttttaaaaagtacaaaaacagaaagatcgatcttctgctcaagagcatcaataacaataaaattaacctggagtataagaaagaaaacgtcaatgaggagatctacgggattaaccccacaaatgaccgggaaatgacgttctatgagcttctgaaggaaatcattgagaaaaaggatgaacaaaagtccatcctcgaggagaaactggacaactttgatatcaccaatttcctggaaaacattgagaagatctttaatgaagagacagagattaacatcattaaaggaaaggtgctcaatgaactgcgcgagtacatcaaagaaaaggaggaaaacaattctgacaacaaacttaagcagatctataatctggagctcaagaaatacattgagaacaatttcagctacaagaaacagaagtccaaatctaagaacggcaagaacgactatctgtaccttaatttcctgaaaaagatcatgtttattgaagaggttgatgagaaaaaggaaatcaacaaagaaaagttcaagaataaaattaacagcaattttaagaacctcttcgtgcagcatatcctggactatgggaaactgctctactataaggagaatgatgagtacattaaaaacaccggacaactggaaacaaaggaccttgagtatatcaagaccaaagaaacactgatcagaaagatggctgtcctcgtgtcctttgccgcgaatagctactacaacctgttcggccgggtttctggcgatattcttgggaccgaggtggtcaaatccagcaagacgaatgtgatcaaagtgggatctcacatttttaaggagaaaatgctgaactatttctttgacttcgaaatctttgatgctaataagattgtcgagatcctcgaatccatcagctactctatttataacgttcgcaatggcgtggggcatttcaacaagctgatcctgggaaaatacaagaaaaaggacattaacaccaataaaagaatcgaggaagatctcaacaataacgaggagattaagggctattttatcaagaaaagaggggaaatcgagcgcaaggtgaaagaaaagttcctgtccaataaccttcagtactattacagcaaagagaagattgaaaattacttcgaggtctatgagtttgaaatcctgaagagaaaaattcctttcgccccgaactttaagcggatcattaaaaagggagaggacctcttcaataacaaaaataacaagaagtacgaatattttaaaaatttcgataagaactccgccgaggagaaaaaggaatttctgaaaacaagaaatttcctgcttaaggagctctactataacaacttttacaaggagttcctgtctaaaaaggaagaatttgagaaaatcgtgctggaagttaaggaggagaaaaagagccgcggcaatatcaacaataaaaagtccggcgtgagcttccagtctattgacgactatgataccaagatcaacatttccgactacatcgctagcattcacaaaaaggaaatggagcgggtcgaaaaatacaatgaggagaagcagaaagatacagccaagtatatcagagactttgtggaagagattttcctcaccgggttcatcaactacctggaaaaggataaacgccttcattttctgaaggaggagttctctatcctctgcaataacaataacaatgttgtggactttaacattaatatcaacgaagagaaaattaaggagttcctgaaagaaaatgatagcaagacgctgaacctttatctctttttcaatatgatcgactccaagcggatttctgaatttagaaacgagctggtcaaatacaagcaattcaccaaaaagcgcctggatgaagagaaagagtttctcggaatcaagatcgaactgtatgagacacttattgagttcgtgatcctgacacgggaaaagctcgacaccaaaaagagcgaagagattgatgcttggctggtcgacaaactgtacgtgaaggattccaacgagtataaagaatacgaggaaatccttaagctctttgttgacgagaaaattctgagctctaaggaggccccctactatgcgaccgacaataagacacctatcctgctctccaacttcgagaaaacgagaaagtacggcacccagagcttcctgtctgaaatccagtccaattataaatacagcaaggtggaaaaagagaacattgaagattataataagaaggaggagatcgaacagaaaaagaaatccaacattgagaaacttcaagacctgaaagtcgaactccacaagaagtgggagcagaataaaatcacagaaaaggagattgagaaatacaacaataccacacgcaagatcaacgaatataattacctgaaaaacaaggaggaactgcagaatgtgtaccttctccacgagatgctgtctgatctgctcgcccggaacgttgcctttttcaataagtgggaaagagactttaaattcattgtgatcgctatcaagcaatttctgcgcgagaacgataaagagaaggtcaacgagttccttaatccccctgacaacagcaaagggaagaaagtgtatttttccgtgtctaagtacaagaataccgttgaaaacattgatggaatccataaaaatttcatgaacctgatttttctcaataacaagttcatgaatcggaaaatcgacaagatgaactgtgctatttgggtctattttagaaattacatcgcccacttcctgcatctgcacacgaaaaacgaaaagatcagccttatttcccagatgaatctgctcatcaagctgtttagctatgataaaaaggtgcagaaccacattctcaaatctacaaagaccctgcttgagaaatacaatatccagattaacttcgagatctccaacgacaagaatgaagtgttcaagtataaaatcaagaaccggctgtacagcaaaaagggcaaaatgctcgggaagaataacaagtttgagattctggaaaatgagttcctggaaaacgtcaaagcgatgcttgagtactctgagtga

SEQ ID NO: 11391 - RNA, 4158 nt, synthetic construct
  misc_feature 1..4158: note = Cas13a variant__Clostridium aminophilum__WP_031473346.1__Cas13a
  source 1..4158: mol_type = other RNA
atgaagttcagcaaagtggaccacaccagatccgccgtcggcatccagaaggctacagattctgttcatgggatgctgtacacggaccccaaaaagcaagaagtgaacgatctcgacaaacggtttgatcagctgaatgtgaaggccaagcgcctttataacgtcttcaatcagagcaaagcggaagaggacgatgacgaaaagagatttggaaaagtggttaagaaactgaaccgggagctcaaggatctgcttttccaccgcgaagtgtccagatacaattctattggcaacgctaagtataattactatgggatcaaaagcaaccctgaggagattgtctccaatctgggaatggtggaatctctcaagggcgagcgggacccgcagaaagttatcagcaagctgctgctctactatctgcgcaaagggcttaagcccggaaccgatggcctgagaatgattctcgaagcctcctgcggcctgcggaaacttagcggggacgagaaggagctgaaggtgtttctccaaacactggatgaagacttcgagaaaaagacctttaaaaagaacctgatccgctctatcgaaaatcagaacatggccgtccagccttccaatgagggagaccccattatcggcattacacaggggagattcaacagccaaaagaatgaagagaagtctgctatcgagcggatgatgtccatgtacgccgatctcaacgaagaccatcgcgaggatgtgctgagaaaacttcggcgcctgaacgtgctctactttaatgtcgacaccgaaaagacagaggaacctaccctgcccggagaggttgatacgaaccctgtgttcgaggtgtggcacgaccatgaaaagggcaaagagaatgatagacagtttgctaccttcgccaagattcttacagaagaccgggagacccgcaaaaaggaaaagctggcggtcaaagaggccctcaacgatctcaagagcgctatccgcgaccacaatattatggcctatcggtgttctatcaaagtgacagagcaggataaggacgggctgtttttcgaagaccagagaatcaaccgcttctggattcaccatatcgagtccgctgttgaacggattctggccagcatcaatccggagaaactgtacaaacttagaattggatatctgggcgagaaggtgtggaaagatctcctgaactacctttccatcaagtatatcgcggtcggcaaagccgtgtttcacttcgctatggaagacctggggaagaccggacaagatattgagctcggcaaactgtctaatagcgtttccgggggactgacgagctttgactacgaacagatccgcgccgatgagacactccagcggcaactgtctgtggaagtcgctttcgccgccaacaatctttttagagctgtggtcggccagaccgggaagaaaattgagcagtccaagagcgaggaaaacgaggaagacttcctgctctggaaggcggagaaaatcgccgaatctattaagaaagagggagagggcaatacacttaagagcatcctgcagtttttcggcggggcttcctcttgggatctgaaccatttttgcgccgcctatggaaatgaaagctccgctctcggctacgagaccaaattcgccgacgatctgcgcaaggcgatctacagcctgcggaacgaaacctttcacttcacaacgctcaacaaggggtcttttgactggaatgctaaactgattggagatatgttctcccacgaggccgccaccggcatcgctgtggaaagaacacgcttctatagcaacaatcttcccatgttttaccgggagtctgacctgaagagaattatggatcatctctataacacctaccaccctcgggcctcccaagttcccagcttcaattccgtgtttgtccgcaaaaacttcagactgtttctgtctaatacacttaacaccaatacgagcttcgacacagaggtgtatcagaagtgggaatccggggtttactatctctttaaagagatctactacaactctttcctgcctagcggcgacgctcatcacctgtttttcgaaggactccggagaattagaaaggaggccgataatctgcccatcgtgggcaaggaggcgaaaaagcggaacgccgtccaggactttgggagacgctgtgatgaacttaaaaatctgtccctcagcgctatttgccagatgatcatgaccgagtataacgaacaaaataacggaaacagaaaggtgaaatctacccgggaggacaagcgcaagccggatatcttccagcattacaaaatgctgctgcttagaacactccaggaagcctttgctatttatatccggcgcgaggagttcaagttcatttttgacctgcctaaaaccctgtacgtgatgaagcccgttgaagagttcctccctaattggaaatccggcatgtttgatagcctggtcgaaagagtgaagcagtctcccgaccttcaacggtggtatgtgctgtgtaaattcctcaacgggcgcctgctgaatcagctttccggagtcatcagaagctacattcagtttgccggcgatatccagcggcgcgcgaaggccaaccacaatagactctatatggacaacacacaacgggtggagtactactctaatgttctggaagtggtcgatttctgcatcaaggggacgagcagattttccaacgtgttcagcgactattttcgcgatgaggacgcttacgccgactatctggataattacctccagttcaaagacgagaagattgctgaagtttcttcctttgccgccctgaaaaccttctgtaacgaggaagaggtgaaggctggcatctatatggatggagaaaatcccgtcatgcagcggaacattgtgatggcgaaacttttcggccctgacgaggttctgaagaatgtggtcccgaaggtgacaagagaggaaatcgaggaatactatcaactcgagaaacagattgccccctaccgccagaacgggtactgcaagagcgaggaagatcagaaaaagctgctgcggtttcaaagaatcaaaaatcgcgtggagttccagaccatcacagaattttccgagattatcaacgaacttctgggacagctcatttcttggagcttcctgcgggagagagacctcctgtattttcagcttggcttccactacctgtgtctccataacgataccgagaagcctgctgaatataaggagatctcccgcgaagacgggacggtcattcggaatgccatcctgcaccaagttgccgctatgtacgtgggaggcctgcccgtgtatacccttgccgataaaaagctggcggcttttgagaaaggggaagccgactgcaagctctctatcagcaaagatacagccggcgctggaaagaagattaaagacttctttagatactccaagtatgtcctgatcaaagaccggatgctcaccgatcagaaccagaagtacacaatttacctggccggccttgagctgttcgagaataccgacgaacatgataacatcacggacgtgcgcaaatatgttgatcactttaagtactatgcgacatctgacgagaatgctatgagcattctcgatctgtactccgaaatccacgacagattctttacctatgatatgaagtaccagaaaaacgtggccaatatgctggagaacattcttctgcggcatttcgtcctcatccgccctgagttctttacagggagcaagaaagtgggagaaggcaagaaaatcacctgtaaggccagagctcaaattgagatcgccgaaaatgggatgcggtctgaggacttcacctataaactgtccgatggaaagaagaacattagcacatgcatgatcgctgccagagaccagaaatacctcaatacggttgcgcgcctgctttactatccccacgaagccaagaaatctattgtggatacccgggagaagaaaaacaataagaagacaaacagaggcgacgggacctttaataaacagaagggcacagctcgcaaagagaaggacaacggaccgcgggagttcaatgataccggcttttccaacacgcctttcgccgggtttgaccccttcagaaacagctga

SEQ ID NO: 11392 - RNA, 4035 nt, synthetic construct
  misc_feature 1..4035: note = Cas13a variant__Eubacterium rectale__CVRQ01000008.1__Cas13a
  source 1..4035: mol_type = other RNA
atgctgagacgggacaaggaggtgaaaaagctctacaacgtcttcaatcagatccaagttggcaccaaacccaagaaatggaacaatgatgaaaagctgagccctgaggaaaacgagcgcagagcccagcagaagaatattaaaatgaagaactataaatggcgggaggcttgctccaagtacgtggaatctagccagcgcatcattaatgacgtgatcttttattcctacagaaaagccaagaacaaacttcggtatatgcgcaaaaatgaggatattctgaagaaaatgcaagaagcggagaagctctctaaattcagcgggggaaagctggaagactttgtcgcttacacacttagaaaatccctggtggtttctaagtatgatacgcaggagttcgacagcctcgccgccatggtggtctttctggagtgtatcggcaagaacaatatctccgatcacgaacgggagattgtgtgcaaactgctcgaactgatccgcaaggacttcagcaaacttgatccgaacgttaaggggtctcagggagctaatattgtgagatccgtccggaaccagaatatgatcgtgcaaccccagggcgaccgctttctgttccctcaggtgtacgccaaagagaacgaaaccgtcacaaacaagaatgttgagaaggaggggctcaacgaatttctgcttaattacgctaacctggatgacgagaaaagagccgaaagcctccggaagctgcgccggattctggatgtgtatttctctgcgcccaatcattacgagaaagacatggacatcaccctctccgataacattgaaaaggagaaatttaatgtgtgggagaagcacgaatgtggaaagaaagagacaggcctgttcgtcgacatccctgatgtgcttatggaagccgaggctgaaaacatcaagctggacgccgttgtggagaaaagagagagaaaggtcctcaatgatcgcgtgcggaaacagaacattatctgctatagatacacccgcgctgttgtggaaaagtataatagcaacgagcccctgtttttcgaaaataacgccattaatcaatactggatccatcacattgagaacgcggtcgagcggatccttaagaactgtaaagccggcaagctgttcaaactcagaaaggggtatctggctgaaaaagtgtggaaggacgccatcaatctgatttctatcaaatacattgctctcggaaaggccgtctacaactttgccctggatgacatctggaaggataaaaagaataaagagcttggcattgtggacgaacgcatccggaacgggatcacatccttcgattatgagatgattaaggctcatgaaaatctgcagagagagctcgcggttgacatcgcctttagcgtgaacaatctggctcgcgccgtctgcgacatgtccaaccttggaaataaagagtctgatttcctgctctggaagcggaacgacattgccgataagctgaaaaataaggacgatatggctagcgtgtccgccgttctgcagtttttcggcgggaaaagctcttgggacatcaacatttttaaggatgcgtacaaaggaaagaagaaatataattacgaagtgagattcatcgacgatctccgcaaggctatttattgtgcccggaacgagaattttcacttcaaaaccgccctggtcaacgacgaaaagtggaacacggagctttttggcaaaatcttcgaaagagagaccgagttttgcctgaatgtggaaaaggatcggttctactccaacaatctctatatgttctaccaagtgagcgagctgcgcaacatgctggaccacctttactctagaagcgtttcccgggctgcccaggtcccttcttataatagcgtgatcgtgagaacagcttttccggaatacattaccaacgtcctcggctatcagaagccctcctacgatgccgacacactggggaaatggtatagcgcgtgttactatctgctcaaggagatctactacaattctttcctgcagtccgaccgcgcccttcaactgtttgaaaagagcgtgaagaccctctcttgggatgacaaaaagcagcagcgggctgttgataacttcaaagaccatttttccgatattaagagcgcctgcacgtccctggctcaggtgtgtcaaatctatatgacagagtacaatcagcagaacaatcagattaagaaagtcagatctagcaacgactccatcttcgatcaacctgtgtatcagcactacaaggttctgcttaaaaaggccatcgcgaatgcctttgctgactatctcaaaaacaataaggatctgttcggatttattggcaagcccttcaaagccaacgagatccgcgaaattgacaaggagcagtttctgcctgattggacctctagaaaatacgaagctctctgcatcgaggtgagcgggtcccaggagctgcaaaagtggtatattgtcggaaaattccttaacgcccggagcctgaatctcatggtgggctctatgcgctcctacatccagtacgttacagacatcaagagacgggccgctagcattgggaacgaactgcatgtgtctgtccacgatgtggagaaggtggaaaaatgggtccaggttatcgaggtgtgctccctgcttgcgagccgcacctctaatcaatttgaagactatttcaacgacaaggatgactacgccagatatctcaaaagctacgtggatttctccaatgtcgacatgcccagcgagtattctgctctggtggatttttccaacgaggaacagagcgacctgtacgttgatccgaagaatcctaaagtgaaccggaatattgtccactccaaactcttcgccgccgaccatatcctgcgcgatattgtggagcccgtttctaaggacaacatcgaagagttttatagccagaaggctgaaatcgcctactgtaagattaaaggaaaggagatcaccgcggaggaacagaaagctgtgcttaagtaccaaaagctgaaaaatagagtcgagctccgggatattgtggaatatggcgagatcattaacgaactgctgggccagcttatcaattggtccttcatgcgcgagagagacctcctgtactttcagctggggttccactatgactgcctccggaacgattctaagaaacctgagggatacaagaatattaaagttgacgaaaacagcatcaaggatgccatcctgtatcagattatcggcatgtacgtgaatggggtcacagtgtatgcccccgagaaagacggagataaacttaaggaacaatgtgtgaagggcggggtcggcgttaaggtgtccgcttttcatagatactctaaatacctgggactcaacgagaagacgctgtataacgccggcctggagattttcgaagtggtcgcggagcacgaagacatcattaatcttcgcaacgggatcgatcattttaaatactatctgggagactaccggagcatgctctccatctatagcgaggtgttcgatagatttttcacctacgacattaagtatcagaagaatgttctgaacctcctgcagaatatccttctgcgccacaacgtgattgtcgaacccatcctcgagtctggcttcaaaacaattggggagcagaccaagcctggagctaaactgtccatccggagcatcaagtctgatacatttcaatacaaagtgaagggcgggaccctgattacggacgccaaggatgaaagataccttgagacaatccgcaaaattctgtattacgccgaaaatgaggaagacaacctcaagaaatccgttgtggtcaccaatgctgacaagtatgagaaaaacaaggagagcgatgaccagaataagcagaaagaaaagaaaaacaaggataataaaggcaagaaaaacgaggaaaccaagtctgacgccgagaagaataacaacgaacggctgtcctacaatccgttcgctaacctcaattttaaactgagcaactga

SEQ ID NO: 11393 - RNA, 3858 nt, synthetic construct
  misc_feature 1..3858: note = Cas13a variant__Herbinix hemicellulosilytica__CRZ35554.1__Cas13a
  source 1..3858: mol_type = other RNA
atgaagctgaccagacggcgcatcagcggcaactccgtggaccagaaaattacagccgctttctacagagatatgtctcaagggctcctgtattacgacagcgaggataatgactgcacggataaggtcatcgaatccatggactttgagcggtcttggcgcggacggattcttaaaaacggcgaagatgacaagaatcccttctatatgtttgttaaagggctggtgggaagcaacgataagatcgtgtgtgagcctattgacgtcgattccgacccggataatctcgacatcctgatcaacaagaatcttaccggcttcgggcggaacctgaaagcccccgactctaatgatacactcgaaaacctgattcgcaagatccaggcgggcattcctgaggaggaagtgctgcccgagctcaaaaagatcaaagaaatgattcagaaggacatcgttaatagaaaggagcagctgcttaaaagcattaagaacaatcggatccctttttccctggagggaagcaaactcgtgccctctaccaagaaaatgaagtggctgttcaaacttatcgatgtccctaacaagacatttaatgaaaagatgctggagaaatactgggaaatttatgactacgataagctcaaagctaacatcaccaaccgcctggacaagacagataaaaaggccagatccattagccgggccgtgtctgaggaactgcgcgagtatcacaagaatctcagaaccaactacaatcggttcgtttccggcgaccgcccggctgccgggctggataacggaggcagcgctaaatacaatcccgacaaggaggaatttcttctgttcctcaaagaggtggaacaatattttaagaaatacttccctgtcaagtctaagcattccaacaaaagcaaggataaatccctggtggacaagtataaaaattactgctcttataaggtggtcaagaaagaggttaacagaagcatcattaatcagcttgtggccgggctgatccagcagggaaagctcctgtactatttttactacaacgacacgtggcaagaagatttccttaattcctatggcctcagctacatccaggtggaggaggcgttcaaaaagtctgtcatgacctccctgagctgggggattaaccggcttacatctttctttatcgacgatagcaataccgtgaaatttgacgatattacaaccaagaaagccaaggaagctatcgagtccaactatttcaataagctgagaacgtgttctcgcatgcaggaccactttaaagaaaagctcgccttcttttaccccgtttatgtgaaagataagaaagaccggcctgatgacgatattgagaacctgatcgtccttgtgaagaacgctatcgaaagcgtttcctacctgagaaatcgcacattccattttaaggagagctctctcctggagctgctcaaagaactggacgataagaactccggacagaataaaattgactatagcgtggccgcggagttcatcaagcgggacattgaaaacctttacgatgtctttagagagcaaatccgctctctgggcattgccgagtactataaagctgacatgatctccgattgcttcaagacctgtggcctcgaatttgccctgtacagccccaaaaattccctgatgccggctttcaagaacgtgtataagagaggggccaatcttaacaaagcctacattagagacaagggacctaaagagacaggcgatcaggggcaaaattcttataaggctctcgaagagtaccgcgaactgacctggtatatcgaggtcaagaacaatgaccagagctacaacgcgtacaaaaatctgctccagctgatctattaccacgccttccttcccgaggtgcgggaaaacgaggctctgattaccgattttatcaatagaacaaaggaatggaaccgcaaagagacggaggaacggctcaacaccaagaataacaaaaagcataaaaatttcgacgagaacgatgacattacagttaatacctatagatacgaatccatccctgattatcagggagagtctctggacgattacctgaaggtgcttcagcggaagcaaatggcccgcgccaaagaagtcaacgagaaggaagagggcaataacaattatattcagtttatcagagacgtggttgtgtgggctttcggggcctacctcgagaacaaactgaagaattacaaaaacgaactgcagcctcccctcagcaaggagaatatcggactgaacgacacacttaaggaactgtttcccgaggagaaagtcaagtccccgttcaatattaaatgccggtttagcatctctaccttcattgataacaagggcaaatccacggacaacacaagcgcggaagctgtgaagaccgatggcaaggaggacgaaaaagataagaaaaatatcaagagaaaagacctcctgtgtttttatctgttccttcgcctcctggatgagaacgaaatttgcaagctgcagcaccaatttatcaagtaccggtgttctctcaaagagagacgcttccccgggaatagaaccaagctggagaaagaaacagagcttctggccgaactcgaggaactgatggagctggtgcggtttaccatgccttccatccccgagattagcgccaaggctgaatctggatatgacacaatgatcaaaaagtacttcaaggatttcattgagaaaaaggtttttaaaaaccctaagacgagcaatctttattaccactccgacagcaaaacccccgtcacacgcaagtatatggccctcctgatgagatctgctccgctgcatctctacaaagatatcttcaagggctactatctgattaccaagaaagaatgccttgagtacatcaagctgtccaacatcattaaagactatcagaatagcctcaacgaactgcacgagcagctggagcggatcaagctgaaatccgaaaagcagaatgggaaggactctctgtacctcgataaaaaggacttttataaagtgaaggagtacgtggaaaacctggagcaagtcgcccgctataaacatctccagcacaagattaatttcgagagcctgtacagaatctttcggattcacgtggatatcgcggcccgcatggttggatacacacaggactgggaaagagatatgcatttcctttttaaggctctggtgtataacggcgtcctcgaggaacggcgcttcgaggccatttttaataacaatgacgataacaatgacgggagaatcgtgaaaaagatccagaacaacctgaataacaaaaatcgggaactggtttccatgctttgttggaacaagaaactgaataagaacgagttcggcgctattatctggaagagaaatcctattgcccacctcaaccattttacccaaacggagcaaaattctaaaagctccctggaatctctcatcaacagcctgcgcattcttctggcgtacgatcggaagagacagaatgccgtgaccaaaacaatcaacgacctcctgctgaatgattatcacatccgcattaagtgggagggacgggtcgacgaaggccagatctacttcaacattaaagagaaggaagatatcgagaatgagcccattatccatcttaaacatctgcacaagaaggactgctatatctacaaaaactcctatatgttcgacaagcagaaagaatggatttgcaacgggatcaaggaggaagtgtacgataaaagcattctcaagtgtatcggaaatctgtttaagttcgactacgaggataaaaacaagtcttccgctaatcctaaacacacctga

SEQ ID NO: 11394 - RNA, 4314 nt, synthetic construct
  misc_feature 1..4314: note = Cas13a variant__Lachnospiraceae bacterium__WP_022785443.1__Cas13a
  source 1..4314: mol_type = other RNA
atgaagatcagcaaagtgagagaggaaaaccggggcgccaagctgaccgtcaatgctaaaacagccgttgtgtccgagaaccgctctcaggaagggattctctacaatgaccccagcagatatggaaagtcccggaaaaacgatgaggaccgcgatagatacatcgaatctcggcttaagagctccggcaaactgtatcgcattttcaatgaggacaaaaacaagagagagacggatgaactgcaatggtttctctctgagatcgtgaaaaagattaatcggcgcaacgggctggtccttagcgacatgctgtccgtggatgacagagcgttcgaaaaggcttttgagaagtacgccgagctcagctataccaatcggcgcaacaaggtttctggatcccctgccttcgaaacatgcggcgtggatgctgccaccgctgagagactgaaagggatcatcagcgaaacaaattttattaaccggatcaagaataacattgacaataaagtctctgaggatatcattgaccgcatcattgccaagtacctgaaaaagtccctctgtagagaacgggtgaaaagaggactgaagaaacttctgatgaacgcgttcgatctcccgtatagcgaccccgacatcgatgttcagcgcgactttatcgattacgtgctggaggacttctaccacgtccgggccaaatctcaggtgtccagaagcattaagaacatgaatatgcctgtgcagcccgagggcgatggcaaatttgctatcaccgtctccaaagggggaacagaatctggcaacaaacgcagcgccgagaaggaggctttcaagaaatttctttccgactatgccagcctggatgaacgggttagagacgatatgctccgccggatgagacgcctggtggtgctgtacttctatgggtctgacgattccaagctcagcgacgtcaatgaaaaatttgacgtgtgggaggatcatgcggcccggagagttgacaaccgcgagttcattaagctgcctcttgaaaataaactggctaacggaaagaccgataaggacgccgagcggatcagaaagaatacggtgaaggaactctaccggaaccaaaatattggctgctatcgccaggctgtcaaagccgtggaggaagataacaatgggagatacttcgacgataagatgctgaacatgtttttcatccaccggatcgagtatggagttgagaaaatttacgccaatcttaaacaggtgaccgaatttaaggctagaacaggctacctgtctgagaaaatctggaaggacctcattaactatatcagcattaaatacatcgcgatgggcaaggccgtctataattacgctatggatgaactgaacgcctccgacaaaaaggagatcgagctggggaaaatttctgaagagtatctcagcggaatctccagcttcgattacgaactgattaaggccgaggaaatgcttcagcgcgagaccgctgtgtatgtcgcctttgcggctcggcatctgtcttcccaaacagtggagctcgacagcgaaaactctgatttcctgcttctgaagcccaaaggcaccatggacaagaatgacaaaaacaagctcgcctccaataacatcctgaattttctgaaagataaggagacgctcagagacacaattctgcagtacttcgggggacacagcctttggaccgattttcctttcgacaagtacctggccggcgggaaagatgacgttgattttctcacagacctgaaggatgtgatctattccatgcgcaacgactctttccattacgctaccgaaaatcacaacaatggaaaatggaacaaggagctgattagcgccatgtttgaacacgagaccgagagaatgacagtcgtgatgaaagataagttctattccaataaccttccgatgttctacaagaatgacgatctcaaaaagctgctgatcgacctctataaagacaacgttgaacgggcttctcaggtgcccagctttaataaggtcttcgtgcgcaaaaactttcctgccctggtgagagataaggacaaccttggcatcgagctggatctcaaggcggacgccgataaaggcgaaaatgagctgaagttctacaacgctctgtattacatgtttaaagaaatttactataatgccttccttaacgacaagaatgttcgggagcgctttatcacgaaagctaccaaggtcgccgataactacgacagaaataaagagcggaacctcaaggatcgcattaagtccgcggggagcgacgaaaagaagaaactgagagagcagctgcaaaattatatcgccgaaaacgatttcggacagcggattaagaatatcgtccaggtgaaccccgactacacactcgctcaaatctgtcagctgattatgaccgagtataatcagcagaacaatggctgcatgcagaaaaagtctgccgctcgcaaggacatcaacaaagattcctaccaacattataagatgcttctgctcgtgaacctgagaaaagcctttctggagttcattaaggaaaattacgcctttgtgcttaaaccttacaagcacgacctctgtgataaggctgacttcgttcccgattttgcgaaatatgtgaagccgtacgccgggctgatcagccgggtcgctggatcttccgagctgcagaaatggtatattgtgagcagattcctctctcctgcccaggccaaccatatgctgggcttccttcacagctacaagcaatatgtttgggacatctaccgccgggcttccgaaacagggaccgagatcaatcacagcattgccgaagataaaatcgcgggcgtggacattacggatgtcgacgctgtgatcgatctgtctgttaagctctgcggaacaatttccagcgagatctccgactattttaaggatgacgaggtgtacgccgaatacatctctagctatctggacttcgagtacgatggcgggaactataaagactccctgaatagattttgtaactctgatgccgtcaatgaccagaaggtggctctttactatgatggagaacatcccaaactcaaccgcaatattatcctgagcaagctgtacggcgagcggagattcctcgagaaaattaccgaccgcgtgtcccggtctgatatcgtcgaatattacaagctgaagaaagagaccagccagtaccagacaaaggggatttttgactccgaagatgagcagaaaaacatcaagaaattccaagaaatgaagaatattgttgagtttagagaccttatggattatagcgaaatcgccgacgagctgcagggacagctcatcaactggatttacctgcgcgagcgggatctgatgaatttccaacttggctatcactacgcgtgcctgaacaatgactctaacaaacaggctacctatgtgacactcgactaccaggggaagaagaatagaaaaatcaacggcgccattctgtatcaaatctgtgccatgtacattaacggactccctctgtactatgtggataaggactccagcgaatggacggtctctgatggcaaagagtccaccggggctaagatcggagaattttaccggtatgccaagagcttcgagaatacatctgactgctacgcttccggccttgagatctttgaaaacattagcgagcatgataatatcaccgaactgcgcaactatattgagcacttcagatactattccagcttcgaccggtcttttctcgggatctacagcgaagtgttcgatcgctttttcacatacgacctgaagtatagaaagaatgttcccaccattctgtacaacatccttctgcagcattttgtgaatgtccggttcgagtttgtgtccggcaaaaagatgatcggaattgataaaaaggacagaaaaatcgccaaggagaaggaatgtgcgcgcattacgatccgggagaaaaacggggtttattctgaacagttcacctacaagctcaaaaatggcacagtgtatgtcgatgccagagacaagcgctacctgcagagcattatccggctcctgttttatcccgagaaagtgaacatggacgaaatgattgaggttaaggagaagaaaaagccttccgataataacaccggaaaaggctactctaagagagaccgccaacaggatcggaaagaatacgacaagtataaagagaagaagaaaaaggaagggaatttccttagcggaatgggcgggaacatcaattgggatgagatcaacgctcagctgaaaaactga

SEQ ID NO: 11395 - RNA, 3156 nt, synthetic construct
  misc_feature 1..3156: note = Cas13a variant__Listeria newyorkensis__WP_036091002.1__Cas13a
  source 1..3156: mol_type = other RNA
atgaagatcaccaaaatgagagtggacggccggacaattgtcatggagcgcacgagcaaggaagggcagctgggatacgagggcatcgatgggaacaaaaccacagaaattatcttcgacaagaaaaaggagtccttttataagtctattctcaataaaaccgttagaaagcccgatgaaaaagagaagaaccggcgcaaacaagccatcaataaggctatcaacaaggagattacagaactgatgcttgccgtgctgcaccaggaggtgcctagccagaaactccataatctgaagtcccttaacaccgaatctctgacaaaactcttcaagccgaaatttcagaatatgatcagctatcccccttccaagggagcggagcacgtccaattctgcctgaccgacattgctgtgcccgccatcagagatctggacgagattaaacctgattggggcatctttttcgaaaagctcaagccctacacggactgggccgagtcttacattcattataaacagaccacaatccaaaagagcatcgaacagaacaaaattcagtcccctgatagcccgcggaagctggttcttcagaaatacgtgaccgcttttctgaatggggagcccctcggactggaccttgtcgccaagaagtataaactggctgatctcgccgaatctttcaagctggtggacctgaacgaggataaatccgcgaattacaagatcaaagcctgtctccagcagcaccaacgcaacattctggacgagcttaaggaagaccctgagctgaatcagtacggcatcgaagttaagaaatatattcagagatactttcccatcaagcgggctcctaaccgcagcaaacatgccagagctgatttcctcaagaaagagctgatcgaatctacagtggagcaacagtttaagaatgccgtctatcactacgtgcttgagcagggcaagatggaagcgtatgagctgaccgaccccaaaacgaaggatctccaggacattcggtccggggaagccttcagctttaaattcatcaacgcttgcgccttcgcttctaacaatctgaagatgattctgaacccggagtgtgaaaaagatatcctcggaaagggcaattttaaaaagaacctgcctaattccacaacccgcagcgacgtggtcaagaaaatgattcccttcttttccgatgagcttcaaaacgttaatttcgacgaggccatctgggccatcagagggtctattcagcagatccggaacgaagtgtaccactgcaagaaacatagctggaagtccattctgaaaatcaagggatttgagttcgaacctaataacatgaagtatgctgatagcgacatgcagaaactcatggataaggacattgcgaaaatccccgagtttattgaggaaaagctgaaatcttccggcgtggtccgcttctacagacacgacgagcttcaaagcatctgggaaatgaagcaggggttttctctgctcacaaccaatgcccccttcgtgcctagctttaagcgggtttacgctaaaggacatgattatcagacctccaagaacagatactataatctggacctgacaacgttcgatatcctcgagtacggcgaagaggactttcgcgcccggtatttcctgaccaaacttgtgtactatcagcaattcatgccgtggtttacagccgataacaatgctttcagagacgccgcgaactttgtcctgcgcctcaacaagaatcggcagcaggatgctaaagccttcattaacatcagagaggtggaagagggcgaaatgccccgcgactacatggggtacgttcagggacaaattgccatccacgaggattctattgaagacacccctaatcactttgagaagttcatcagccaggtgtttatcaagggcttcgatcggcatatgagatccgctaacctgaaatttattaagaatccccgcaaccaggggctggagcaaagcgaaatcgaggaaatgtctttcgacattaaagtcgagccttcctttcttaagaataaagatgactatatcgccttctggatcttttgtaagatgctcgacgctcggcacctgagcgaactgagaaacgagatgattaaatacgatggacatctcacaggcgagcaggaaatcattgggctggcccttctgggagtggactctcgcgagaatgattggaagcagttcttctccagcgaacgggagtatgagaagatcatgaaaggctacgtcgtggaggaactctatcagagagaaccctaccggcaatccgacggcaagaccccgattctgtttcgcggggttgagcaggcgagaaaatatggaacggaaacagtgatccagcggctgttcgatgccaaccctgagtttaaggtctctaaatgcaatcttgctgagtgggaaagacagaaggagaccattgaagagaccatcaagcgccggaaagaactccacaacgagtgggccaagaatcccaaaaagcctcaaaacaatgctttctttaaagagtacaaggaatgttgcgacgccatcgatgcgtacaactggcataagaacaaaacaaccctggcctatgtgaatgagctgcaccacctcctgattgaaatccttggcagatacgttgggtatgtggctattgccgaccgcgatttccagtgtatggctaaccagtactttaagcatagcggaatcacagagagagtcgaatattggggcgacaatcggctgaaatccattaagaaactcgatacgttcctgaagaaggaggggctgtttgtgtctgagaaaaacgcccgcaatcacatcgcccatcttaactacctcagcctgaagtccgaatgcaccctgctctatctgagcgagagacttcgggaaattttcaaatacgaccgcaagctgaaaaatgctgtgtctaagtccctcatcgatatcctggacagacacggcatgagcgttgtctttgcgaacctgaaggagaataaacaccggcttgtgattaagtctctcgagcccaaaaagctgcgccatctgggaggcaaaaagatcgacgggggatacattgaaacaaaccaggtgtccgaggaatattgtggcatcgtcaaaagactcctggagatgtga

SEQ ID NO: 11396 - RNA, 3363 nt, synthetic construct
  misc_feature 1..3363: note = Cas13a variant__Listeria seeligeri__WP_012985477.1__Cas13a
  source 1..3363: mol_type = other RNA
atgtggatcagcattaagaccctgatccaccatctcggcgtgctgttcttttgcgactacatgtataacagacgggagaaaaagattatcgaagtcaaaacaatgcgcattacgaaggttgaggtggatcggaaaaaggtgcttatctccagagacaagaatgggggaaaactggtctacgaaaacgagatgcaggataataccgaacaaatcatgcaccataagaaatctagcttctataagtccgtggttaacaaaacaatttgtcgccccgagcagaagcagatgaagaaactcgtgcacggcctgcttcaggaaaattctcaagaaaagatcaaagtcagcgacgtgaccaagctgaacatttccaattttctcaaccatagattcaaaaagtctctgtactattttcctgagaatagcccggataaatccgaagagtaccggatcgagattaacctgagccagctcctggaagactctcttaagaagcagcaggggacattcatctgctgggagtcctttagcaaagatatggaactgtatattaattgggccgagaactacatctcttccaagaccaaactcatcaagaaaagcattcgcaataacagaatccaatctacagaatcccggagcggacagctgatggaccgctacatgaaggatattcttaataagaacaaacccttcgacatccagtccgtttctgagaagtatcagctggagaaactcaccagcgctctgaaggccacgtttaaagaagcgaagaagaacgataaagagattaattacaagctgaaatccaccctccaaaaccacgaaagacagatcatcgaggaactgaaggagaatagcgagcttaaccagttcaatattgaaatccggaaacacctggagacatattttcctattaagaagaccaaccgcaaagtgggcgacatcagaaatctcgaaattggggagatccaaaagatcgtcaaccatcggctgaaaaataagattgtgcagcgcatccttcaggaaggaaaactggcttcttacgagattgagtccacagtgaacagcaattctctccagaagatcaaaattgaagaggccttcgccctgaagtttatcaacgcttgtctgttcgccagcaataacctcagaaatatggtctatcccgtttgcaagaaagatattctgatgatcggcgagttcaagaactcctttaaagagatcaagcacaaaaagttcattcggcaatggtctcagtttttcagccaggagatcaccgtggacgacattgaacttgcttcctggggcctgagaggggccatcgcgcctattcgcaacgagatcatccatctcaagaaacacagctggaagaaatttttcaataaccccacgtttaaggtgaaaaagtctaagattatcaatggaaaaacaaaggatgtcacctccgagttcctgtacaaagaaacactttttaaggactatttctacagcgaactggattctgtgcctgagctcattatcaacaaaatggagtccagcaagattctggactactattcctctgatcagctgaatcaagtttttaccatcccgaacttcgaactcagcctgcttacctccgccgtgccctttgctccttctttcaagcgggtctacctgaaaggcttcgactatcagaatcaggatgaggcccagcccgactacaacctcaagctgaatatctataacgaaaaggcttttaatagcgaggccttccaagcgcagtactccctgtttaaaatggtgtattaccaggttttccttcctcagtttacaacgaacaatgatctcttcaaaagctctgtggactttattctgaccctgaacaaggaaagaaaagggtacgccaaggctttccaagatatccgcaagatgaataaagacgagaagccctccgagtatatgagctacattcagtctcagctcatgctgtatcagaaaaagcaagaagagaaagaaaagatcaaccactttgagaagttcattaaccaggtctttatcaaaggattcaattcctttatcgaaaagaaccggcttacatacatttgtcatccgaccaaaaatacagtgcctgagaacgacaatatcgagattcccttccacaccgatatggacgatagcaacatcgccttctggctgatgtgcaagctcctggacgctaaacagctgtctgaacttagaaatgagatgattaagtttagctgttccctccaaagcacggaagagatctctacattcaccaaggcccgcgaggtcattggcctggccctgctcaacggggaaaaaggatgcaatgattggaaggagctgtttgacgataaagaggcttggaagaaaaacatgtccctttatgtgagcgaagaactgctccagtccctgccttacacccaggaggacggccagacacccgttatcaatcggtctatcgatctggtgaagaagtatggcaccgagacaattcttgaaaaactcttcagctcctctgacgattacaaggtcagcgcgaaagacatcgccaagctgcatgagtacgatgtgacggagaaaattgctcaacaggaatccctgcacaagcagtggatcgaaaagcccgggctcgccagagactctgcctggaccaaaaagtatcagaacgttattaatgacatcagcaactaccaatgggctaaaacaaaggtggagctgacccaggtccgccatcttcaccagctgacaatcgatctcctgtcccggctggccggatatatgagcattgcggacagagattttcaattctcttccaattacatccttgagcgcgaaaacagcgagtatcgggtgacctcttggattctcctgtccgaaaacaaaaataagaacaaatacaatgactatgagctgtacaacctcaagaatgctagcatcaaggtgtcttccaaaaacgatcctcagctgaaggttgaccttaaacagctgagactcacgctggaatacctggagctttttgataatcggctgaaggagaaacgcaacaatattagccacttcaactatctcaatggccagctggggaactccatcctcgaactgtttgacgatgccagagacgtccttagctacgatcggaagctgaagaatgccgtgtctaaaagcctcaaggagatcctgtcctctcatggaatggaagtgaccttcaaaccgctgtatcaaacaaaccaccatcttaagattgacaaactgcagcccaagaagatccaccacctcggcgagaaaagcaccgtctcctctaatcaggtgagcaacgagtactgtcagctggttagaacactcctgaccatgaagtga

SEQ ID NO: 11397 - RNA, 3465 nt, synthetic construct
  misc_feature 1..3465: note = Cas13a variant__Paludibacter propionicigenes__WP_013443710.1__Cas13a
  source 1..3465: mol_type = other RNA
atgagagtgagcaaggtcaaagttaaggacggcgggaaagataagatggtgctggtgcaccggaaaaccacaggagcccagctcgtctactccggccaacccgtgtctaacgagacgagcaatatcctgcctgaaaagaagcgccagtccttcgacctttctaccctgaacaaaacaattatcaagtttgataccgctaaaaagcagaaactcaatgttgaccagtataagattgtggagaagatcttcaaatacccgaagcaagaactgcccaaacagattaaggccgaggaaatccttccttttctgaaccataaattccaggagcccgtcaagtattggaaaaatgggaaggaggagagctttaacctcacactgctgatcgtggaagcggttcaggctcaagataagagaaaactccagccttactatgactggaagacctggtacattcagacaaaatccgatctgcttaagaaatctatcgaaaataaccggattgacctgaccgagaatctcagcaagcgcaagaaagccctgcttgcctgggagacggagttcaccgcttccggaagcatcgatctgacacactatcataaggtgtacatgaccgacgtcctctgcaaaatgctgcaggatgtgaagcccctgacagacgataaaggcaagattaacaccaatgcctaccacagagggctcaagaaagctctgcaaaaccatcagcctgccatctttggaacgcgggaagtgccgaatgaagcgaaccgcgccgacaatcagctttctatttatcacctggaggtcgttaagtacctcgaacactatttccccatcaaaacatccaagagacggaacaccgctgacgatatcgcccattacctgaaagctcaaacacttaagaccaccattgagaagcagctggtgaacgccatccgcgcgaatattatccagcagggcaaaacaaaccaccatgagctcaaggccgacacgaccagcaatgatctgattagaatcaaaacaaacgaggcttttgtgctgaatctcaccggcacatgtgccttcgctgccaacaatatccggaacatggtcgacaatgaacaaaccaacgatattctggggaagggagactttatcaaatctcttctgaaggataatacgaactcccagctctatagcttctttttcggcgaagggctgtctacaaataaagccgagaaggaaacccagctttggggcattcgcggagctgtgcagcaaatcagaaacaatgttaaccactacaagaaagacgcgctgaagaccgtgttcaacatttccaattttgagaaccctacaatcaccgatcccaaacagcagacaaattatgccgacacgatctacaaggctcggttcattaacgagctcgaaaagatccctgaggcctttgcccagcaactgaagaccgggggagctgtcagctactatacaattgaaaatctgaagtccctcctgaccacattccagttttctctttgccgcagcaccatccccttcgccccgggctttaaaaaggtgttcaacggcgggattaattaccagaacgcgaaacaggatgagtccttttatgaactgatgctcgagcaatacctgagaaaggagaatttcgctgaagagagctataacgcccggtactttatgctgaaacttatctataataacctcttcctgcctggatttacgaccgacagaaaggccttcgctgactctgttggcttcgtgcagatgcagaataagaaacaagccgaaaaggtcaacccccgcaaaaaggaggcttacgcctttgaggcggtgcggcctatgacagccgctgattccattgccgactacatggcttatgtccagagcgaactgatgcaggagcagaataaaaaggaagagaaggtggccgaagagaccagaatcaacttcgagaaatttgttctccaagtgttcatcaaggggtttgattctttcctgcgcgcgaaagaatttgacttcgtccagatgccccagccccagcttacagccaccgctagcaaccaacagaaggccgataaactgaatcagctcgaggcttccattacggccgactgtaagctgacacctcagtacgccaaagctgatgacgcgacccacatcgccttttatgtgttctgcaagctgcttgatgctgcccatctctctaacctgcggaatgaactgattaagtttagagagagcgttaacgagttcaaatttcaccatctcctggaaatcattgagatctgtcttctgtccgccgacgtggtcccgacagattaccgcgacctctatagctctgaagctgattgcctggcccggctgagacccttcatcgagcaaggagcggacattaccaattggtccgaccttttcgtgcagagcgataagcactctcctgtgatccatgctaacattgaactctccgttaaatacggcaccacaaagctgctggagcagatcattaataaagacacgcaatttaagaccacagaagccaacttcaccgcctggaatacagctcagaaaagcatcgagcagctcatcaaacagcgcgaggatcaccacgaacaatgggtcaaggccaaaaacgcggacgataaggagaaacaggaacggaagagagagaagtccaattttgctcagaaattcattgagaagcatggggacgattatctggacatctgtgattacattaacacctacaattggcttgacaacaaaatgcactttgtgcatctgaatcgcctccacggactgacgatcgaactgcttggccggatggccggcttcgtggccctctttgatagagacttccagtttttcgatgagcaacagattgctgacgaatttaagctgcacgggttcgtcaacctgcattctatcgacaaaaagctcaacgaggtgcccacaaagaaaatcaaggaaatttatgatatccggaataaaattatccagattaacggaaataagatcaacgagagcgttcgcgccaatctgattcagttcatctcctctaaaagaaactactataataacgcttttcttcacgtgagcaatgacgagatcaaggaaaagcaaatgtacgatattcggaaccatatcgcccacttcaattatctgaccaaagacgcggccgatttttccctcattgacctgatcaacgagctgagagaacttctgcattacgatcgcaagctcaaaaatgctgtcagcaaggccttcattgacctgtttgataaacacggcatgatcctcaagctgaaacttaacgctgaccacaagctgaaggtggagtctctcgaacctaaaaagatctatcatctggggtccagcgccaaagataagcccgagtaccagtactgcaccaatcaggttatgatggcctattgtaacatgtgccggtctctgcttgagatgaaaaagtga

SEQ ID NO: 11398 - RNA, 3858 nt, synthetic construct
  misc_feature 1..3858: note = Cas13a variant__Rhodobacter capsulatus__ETD76934.1__Cas13a
  source 1..3858: mol_type = other RNA
atgcagatcggcaaggtgcaagggagaaccattagcgagttcggagaccccgccggcgggctgaaacggaagatctccacagatggaaagaaccgcaaggaactccctgctcacctgtctagcgacccgaaagcccttattggccagtggatctccgggattgataagatctacagaaagcccgactctcggaaaagcgatggaaaggcgatccattcccctacgccctctaaaatgcagtttgacgctcgcgatgacctgggcgaggccttctggaagctcgtcagcgaagccggcctggctcaggattccgactatgatcaatttaaaagacggcttcacccttacggggacaagttccagcccgccgatagcggagctaagctgaaatttgaggccgaccctccggaaccccaggcgttccatggccgctggtatggggccatgtctaagagaggaaatgacgctaaagagctcgccgctgccctgtacgagcacctccatgttgatgaaaagcggattgacggccagcctaaacgcaaccccaagaccgataaatttgcgcctgggctcgtggtggccagagctctgggaatcgagtccagcgtccttccccggggcatggcccgcctggctagaaattggggcgaagaggagattcaaacatatttcgtggttgacgtggccgcctctgtcaaggaagtggctaaggcggccgtttccgctgcccaggcctttgatccgcctagacaggtgagcgggcgctctctctcccccaaagtcggattcgctctggccgagcaccttgaaagagtgaccggcagcaagcggtgctcctttgaccctgcggctgggccctctgtgctggccctccacgatgaggtcaaaaagacatacaaaagactgtgtgcccgcggaaagaacgctgcccgggctttccccgccgacaagaccgaactgctcgcgctgatgagacatacacacgagaatcgcgttcggaaccagatggtgagaatgggccgcgtgagcgagtatcgggggcaacaggccggagatcttgctcagtcccattactggaccagcgccggccaaacggaaatcaaagagtctgaaatttttgtcagactgtgggtgggcgctttcgccctcgcggggcgctccatgaaggcctggatcgaccctatgggaaaaattgttaataccgagaagaacgatcgggacctgacagctgccgtgaatatcagacaggtcatcagcaacaaagaaatggtggctgaggccatggcccgccggggcatttacttcggggagaccccggaacttgacagactgggagctgagggcaatgaagggtttgttttcgcgctcctgcggtatctgcgcggctgcagaaaccagacatttcacctcggagcccgggctggcttcctgaaggagatcagaaaggaacttgagaaaacccgctgggggaaggccaaagaggccgaacacgtggtcctgacggataagacagtggctgccattcgggcgatcattgacaatgatgctaaagccctcggagccagactgcttgctgacctgtctggcgcctttgtcgcgcattacgctagcaaggagcacttctccaccctctattctgaaatcgtgaaggccgttaaagatgcccccgaggtgagctccgggctgcctcgcctgaagctcctgcttaaaagagctgacggagtccggggctacgtgcatgggctgcgcgatacaagaaagcacgcctttgctaccaaactgccccctcccccggcccctcgggagctggacgatcccgcgaccaaggcccgctatatcgctctgcttagactctacgacggccctttccgggcctatgctagcggaattacaggcacggccctggccgggcccgctgcgcgcgccaaagaagctgccaccgccctggctcagtctgttaacgtgacaaaggcctactccgatgtcatggagggaagaagctctcggctccgccctcccaatgacggcgaaaccctgagagagtacctttccgcgctgacaggggaaaccgctacggagtttcgggtgcaaatcggatatgagagcgattccgaaaacgccagaaagcaggccgagttcattgaaaactaccgccgggacatgctcgcttttatgttcgaggactatatcagagccaaaggctttgattggattctgaagatcgaaccgggggcgacagctatgacccgcgcccctgtgctgcccgagcccatcgacacccggggccagtacgagcattggcaggccgctctttatctcgttatgcacttcgtccctgcctctgatgtgagcaatctgctgcaccaactcagaaaatgggaagctctgcagggaaagtacgagcttgtgcaggacggcgatgccacagaccaggcggatgcccgccgggaagctctggacctcgtcaaaagattccgcgatgtgctggttctgtttcttaagaccggggaggcccggttcgaaggcagagctgccccgtttgacctcaagcccttccgggccctgtttgctaaccctgcgacattcgatcgcctgtttatggccacgcccaccacagctagacctgccgaggacgatcccgagggagacggggcctccgaacctgagctccgggtggctcgcaccctgagaggacttcggcaaattgccagatataatcatatggcggtcctgtctgacctcttcgctaaacacaaggtgcgcgatgaagaggttgcccggctggccgagatcgaagacgagacacaggagaaaagccagattgtggctgcccaggagctgagaaccgatcttcatgacaaggtcatgaaatgtcaccccaagacgatctccccggaagaacgccaaagctacgcggccgctattaagaccatcgaggaacaccggtttctcgtgggcagagtttacctgggggatcatctgcgcctccaccggctgatgatggacgtgattggcagacttatcgattatgccggagcttacgagcgcgacacaggcaccttcctgatcaacgcctctaaacagctcggggctggagccgattgggcggtcacaattgccggcgctgccaataccgacgctagaacgcagacacggaaggatctggcccattttaacgtgctggaccgcgccgacgggacccctgatcttacagctctggtgaatagagcgcgggaaatgatggcctatgaccgcaaaagaaagaacgctgtcccccggtccatcctcgatatgctggccagactcggactgacccttaaatggcaaatgaaggaccatctgctccaggatgccaccattacacaggctgccatcaagcacctggacaaagttcgcctgacggtgggcggccctgcggccgtgaccgaggctcggttcagccaggattaccttcaaatggtcgccgctgtgtttaatgggtctgttcagaaccccaagccgagacgccgggacgatggagacgcctggcacaaacctcccaagcctgcgacagcccagtcccagcccgatcaaaaaccccctaataaggctccgagcgccggctctagactgccccctccccaggtgggggaagtctatgagggagtggttgtgaaagtcattgacaccggcagcctcgggttcctggctgtggagggagttgccggcaacatcggcctccacatctcccggctgcgccggattcgggaagatgctatcattgtggggcgcagataccggttccgcgtcgagatctatgtgcctcccaagagcaatacatctaaacttaacgccgcggacctggtgagaattgactga

SEQ ID NO: 11399 - RNA, 1578 nt, synthetic construct
  misc_feature 1..1578: note = Cas13a variant__Corynebacterium ulcerans__WP_038617242.1__Cas13
  source 1..1578: mol_type = other RNA
atgcccaagtactgcctgaccgccagattccctctcggcgtgtatctggggcacacaggagacgctaaccgggatgcctacccggaccccgcgcgccttcatgctgccctgatgaatgccgctgcccagggcgtccacgctgaggaagatcctaacgagcatcaactcagacccagccagcagtccctgcaggcccttcaatggctggaagcgcaccctcccacggggctcgccatgcctgagcagcagtggctgtctccggacaccagccggatgatgtatcgcaatgttggatccgtgaaaatcgataagacaggcgtgaccagagctacagaaaaccgggccgtctctgacggggtgagcgttaatggagcttacggctatatttgggatgagatgcccgtggacatcgccgaggcgattaccgccctgctccctgatgtcgcttgtctgggcgaagcctcctctcttgtggttctggagcagcaagaaatcgaggctacactcaccctggacccccaggccacggcctttagcaccgagcgcgtgcaggtcagaattgcgcttcctgggcggacacagcatctgcgcgaagtgttccacgctagatacgggaaaaagcccccgtccaaaaaggccgataagtttctcaaagacgatcctatccacgatccccctatccccaaggaccatctgggcaccgctcggtatctgcgcgtgaacgccgccgacaaagagtgcgtcacaccctggaccaaggttattctcctggaagtgcacgggaaacaacttggagctaaggaacaggtgagagccgcggtcgctctgcatcgggccctcatcgcccgcattagaacggacgtgagccctgttatcacaggccggtacgctgccggggctcagagaccggccaataacctggcgattcaatacatcccccaccgccaccttgaggccctgggactcaagacctctgctttcgccctgctggtgcctcaggatgctgactccacagtctatgagcagctcaatcaggccctgaccggcccctttcctcttcggagcggcgggaaactgctctgtcaactgaagtacaacggacatgtgttcagaggcgatgcgttttggcccgccccgcagcctgggaccattcgcatgtgggagccccttaatgttttcatccctgaatctcggccccacaacaaacagcagggagtgctgtggagactcgctgacgccggcctgctgtccgtcgcttttgtgtggcgcgataatttccctacaaaggagacggggcccgcccggtatgtcgaactcagagacgccgcttacaacgcggatgtgcgcatctttcatgaccacccggttagccggaataccagacgcttcgtgcatcggacaaacagatctctgaccattcaaccttggcggggacttgtccacctgggctccctccagcaggatcgcgccatcattgctctgggccagagcagacacctgggaggaggccttctcatccccgtggacattccccggtccgagtttgaaacaatgacctctgagatgacgcatgcctga

SEQ ID NO: 11400 - RNA, 3675 nt, synthetic construct
  misc_feature 1..3675: note = Cas13b variant__Bergeyella zoohelcum__WP_002664492.1__Cas13b
  source 1..3675: mol_type = other RNA
atggagaacaagaccagcctgggcaataacatctactataatcccttcaaacctcaggacaagtcctactttgccgggtatttcaacgctgccatggaaaatacagattctgtgtttagagagctcggaaaacggctgaagggcaaagaatacacgagcgagaacttctttgacgcgattttcaaggaaaatatctcccttgtcgagtatgagcgctacgttaagctgctctctgattattttccgatggctagactgcttgacaaaaaggaagtgcccattaaagagcggaaggaaaacttcaaaaagaattttaaggggatcattaaagccgtgcgcgatctgagaaacttctacacccacaaggagcatggagaggtcgaaatcacagacgagatctttggcgtgctcgatgaaatgctgaaaagcaccgttctgacagtgaagaaaaagaaagtcaagaccgacaagacaaaagagattctcaagaaatccatcgaaaagcaactggatattctttgccagaaaaagctggagtacctccgggacaccgcccgcaagatcgaggaaaagagacggaatcagcgcgagagaggggaaaaggagctggtggctcctttcaaatattctgataagcgggacgatcttattgccgctatctacaacgacgcctttgacgtttatattgataaaaagaaggacagcctgaaagaatccagcaaggcgaaatacaatacgaagtctgatccccagcaagaggagggagacctcaaaatccctatctccaagaacggcgtggtcttcctgctgagcctcttcctgaccaagcaggaaattcacgcctttaaatctaagatcgctggcttcaaagccacagtgattgatgaggctaccgtgtccgaagccacagtcagccatgggaaaaattctatctgttttatggcgacccacgagattttctcccatcttgcctataaaaagctgaaacgcaaggttagaacggctgaaatcaactacggagaggccgagaacgctgaacagctcagcgtgtatgccaaggagacactgatgatgcagatgcttgacgaactgtccaaagtgcccgatgtcgtgtaccaaaatctctctgaggacgttcagaagacctttatcgaggattggaacgaatacctgaaagagaataacggcgacgtggggacaatggaagaggaacaggtcattcaccctgtgatccggaagcgctatgaggataaattcaattactttgccattagattcctggacgagtttgctcagttcccgaccctccggtttcaagttcacctgggaaactatcttcatgacagcagacccaaggaaaatctgatctccgatcgccggattaaggagaaaatcaccgtgttcggcagactcagcgaactggagcacaagaaagcgctttttatcaagaacacagaaacgaatgaggaccgcgagcattactgggaaattttccctaaccccaattatgatttccctaaagagaacatctctgtcaatgacaaggattttcccattgccgggtccatcctggaccgggaaaagcagccggtggctggaaaaattggcatcaaggtcaaactcctgaaccagcaatacgtgagcgaggttgataaggccgtgaaagcccaccagctgaagcagagaaaggcttctaaacctagcattcagaatatcatcgaagagattgtccccatcaacgagtccaaccctaaggaagccattgtgttcggcgggcaacccaccgcgtatctctctatgaatgacatccacagcattctgtacgagtttttcgataaatgggaaaagaaaaaggagaaacttgagaagaagggagaaaaagagctgcgcaaggaaatcggcaaagagctcgaaaagaaaatcgttgggaagattcaggctcagatccagcaaattatcgacaaggatacaaacgccaaaattctgaagccctaccaggacggaaattccaccgccatcgataaagagaagctgatcaaagaccttaagcaggagcagaacattctccaaaagctgaaagacgaacagacagtgcgggagaaggaatataatgattttatcgcttaccaggacaaaaacagagagattaataaggtccgcgatcggaaccataaacagtatctgaaggacaatctcaagagaaaataccctgaagccccggctcgcaaggaggtgctgtattaccgggagaaaggcaaggtggccgtttggcttgcgaacgatatcaaaagattcatgcccaccgactttaagaatgaatggaagggggagcaacacagcctgctccagaaatctctggcctattacgaacagtgcaaggaggaactgaaaaaccttctccctgagaaggtcttccaacatctgccctttaaactgggaggctacttccagcagaagtatctctaccagttttatacgtgttacctggataaacggcttgagtatatttccggcctggtgcaacaggctgaaaatttcaagagcgagaacaaggtgtttaaaaaggtcgaaaatgagtgcttcaaattcctcaagaaacagaactacacacacaaggagctggacgcccgcgtgcagtctatcctggggtatcctatctttcttgaaagaggattcatggatgagaagcccaccattatcaaaggcaagacctttaaagggaacgaagctctcttcgccgactggtttcggtactacaaggagtatcaaaatttccagacattttacgataccgaaaactatccgctggttgagctggagaaaaagcaggcggacagaaagcgcaaaacaaagatttaccagcaaaagaagaatgatgtgttcacgctcctgatggccaaacatatctttaagtccgtcttcaagcaggacagcattgaccagttttcccttgaagatctgtatcaatctcgggaggaaagactcggaaaccaggagcgcgctagacagaccggcgaacggaatacaaactacatctggaataaaaccgtggacctgaagctgtgtgatgggaaaattacagttgagaacgtgaaacttaaaaatgtcggcgacttcatcaagtatgagtacgatcagcgcgtgcaagccttcctcaaatacgaagagaacatcgaatggcaggcttttctgattaaggagagcaaggaagaggagaattatccttacgttgtggaaagagagatcgaacagtatgagaaagtccggcgcgaggaactgctcaaggaggtgcacctgattgaagagtacatccttgaaaaagtgaaggacaaagagattctgaagaagggagataaccagaatttcaaatattacatcctcaacggcctgctgaagcaacttaaaaatgaggacgtcgaatcctataaggtttttaacctgaacaccgagcccgaagatgtgaatatcaaccagctcaaacaggaggccacggacctggaacagaaggccttcgtgctcacctacattagaaataagtttgctcacaaccaactgcctaaaaaggagttctgggattactgccaggagaaatatgggaagatcgaaaaagagaagacatacgcggaatattttgccgaggtcttcaagaaagaaaaggaggctcttattaaatga

SEQ ID NO: 11401 - RNA, 3675 nt, synthetic construct
  misc_feature 1..3675: note = Cas13b variant__Bergeyella zoohelcum__WP_002664492.1 modified__Cas13b(R116A,H121A,R1177A,H1182A)
  source 1..3675: mol_type = other RNA
atggagaacaagaccagcctgggcaataacatctactataatcccttcaaacctcaggacaagtcctactttgccgggtatttcaacgctgccatggaaaatacagattctgtgtttagagagctcggaaaacggctgaagggcaaagaatacacgagcgagaacttctttgacgcgattttcaaggaaaatatctcccttgtcgagtatgagcgctacgttaagctgctctctgattattttccgatggctagactgcttgacaaaaaggaagtgcccattaaagagcggaaggaaaacttcaaaaagaattttaaggggatcattaaagccgtgcgcgatctggccaacttctacaccgctaaggagcacggagaggtcgaaatcacagacgagatctttggcgtgctcgatgaaatgctgaaaagcaccgttctgacagtgaagaaaaagaaagtcaagaccgacaagacaaaagagattctcaagaaatccatcgaaaagcaactggatattctttgccagaaaaagctggagtacctcagagacaccgcccggaagatcgaggaaaaacgcagaaatcagcgggagcgcggggaaaaggagctggtggctcctttcaaatattctgataagagagacgatcttattgccgcgatctacaacgacgcctttgacgtttatattgataaaaagaaggacagcctgaaagaatccagcaaggctaaatacaatacgaagtctgatccccagcaagaggagggagacctcaaaatccctatctccaagaacggcgtggtcttcctgctgagcctcttcctgaccaagcaggaaattcatgcctttaaatctaagatcgctggcttcaaagccacagtgattgatgaggcgaccgtgtccgaagccacagtcagccacgggaaaaattctatctgttttatggctacccatgagattttctcccaccttgcctataaaaagctgaaacggaaggttcgcacggctgaaatcaactacggagaggccgagaacgccgaacagctcagcgtgtatgctaaggagacactgatgatgcagatgcttgacgaactgtccaaagtgcccgatgtcgtgtaccaaaatctctctgaggacgttcagaagacctttatcgaggattggaacgaatacctgaaagagaataacggcgacgtggggacaatggaagaggaacaggtcattcatcctgtgatcagaaagcggtatgaggataaattcaattactttgcgattcgcttcctggacgagtttgcccagttcccgaccctcagatttcaagttcacctgggaaactatcttcacgacagccggcccaaggaaaatctgatctccgatagacgcattaaggagaaaatcaccgtgttcggccggctcagcgaactggagcataagaaagctctttttatcaagaacacagaaacgaatgaggacagagagcactactgggaaattttccctaaccccaattatgatttccctaaagagaacatctctgtcaatgacaaggattttcccattgccgggtccatcctggaccgcgaaaagcagccggtggccggaaaaattggcatcaaggtcaaactcctgaaccagcaatacgtgagcgaggttgataaggctgtgaaagcccatcagctgaagcagcggaaggcgtctaaacctagcattcagaatatcatcgaagagattgtccccatcaacgagtccaaccctaaggaagctattgtgttcggcgggcaacccaccgcctatctctctatgaatgacatccacagcattctgtacgagtttttcgataaatgggaaaagaaaaaggagaaacttgagaagaagggagaaaaagagctgagaaaggaaatcggcaaagagctcgaaaagaaaatcgttgggaagattcaggcccagatccagcaaattatcgacaaggatacaaacgctaaaattctgaagccctaccaggacggaaattccaccgccatcgataaagagaagctgatcaaagaccttaagcaggagcagaacattctccaaaagctgaaagacgaacagacagtgcgcgagaaggaatataatgattttatcgcttaccaggacaaaaaccgggagattaataaggtcagagatcgcaaccacaaacagtatctgaaggacaatctcaagcggaaataccctgaagccccggcgagaaaggaggtgctgtattaccgcgagaaaggcaaggtggccgtttggcttgctaacgatatcaaacggttcatgcccaccgactttaagaatgaatggaagggggagcaacatagcctgctccagaaatctctggcctattacgaacagtgcaaggaggaactgaaaaaccttctccctgagaaggtcttccaacatctgccctttaaactgggaggctacttccagcagaagtatctctaccagttttatacgtgttacctggataaaagacttgagtatatttccggcctggtgcaacaggctgaaaatttcaagagcgagaacaaggtgtttaaaaaggtcgaaaatgagtgcttcaaattcctcaagaaacagaactacacacacaaggagctggacgcccgggtgcagtctatcctggggtatcctatctttcttgaacgcggattcatggatgagaagcccaccattatcaaaggcaagacctttaaagggaacgaagcgcttttcgccgactggtttagatactacaaggagtatcaaaatttccagacattttacgataccgaaaactatccgctggttgagctggagaaaaagcaggctgaccggaagagaaaaacaaagatttaccagcaaaagaagaatgatgtgttcacgctcctgatggccaaacacatctttaagtccgtcttcaagcaggacagcattgaccagttttcccttgaagatctgtatcaatctcgcgaggaacggctcggaaaccaggagagagctcgccagaccggcgaaagaaatacaaactacatctggaataaaaccgtggacctgaagctgtgtgatgggaaaattacagttgagaacgtgaagctcaaaaatgtcggcgacttcatcaagtatgagtacgatcagcgggtgcaagccttcctcaaatacgaagagaacatcgaatggcaggcctttctgattaaggagagcaaggaagaggagaattatccttacgttgtggaacgcgagatcgaacagtatgagaaagtcagacgggaggaactgctcaaggaggtgcatctgattgaagagtacatccttgaaaaagtgaaggacaaagagattctgaagaagggagataaccagaatttcaaatattacatcctcaacggcctgctgaagcaacttaaaaatgaggacgtcgaatcctataaggtttttaacctgaacaccgagcccgaagatgtgaatatcaaccagctcaaacaggaggctacggacctggaacagaaggcgttcgtgctcacctacattgccaataagtttgctgccaaccaactgcctaaaaaggagttctgggattactgccaggagaaatatgggaagatcgaaaaagagaagacatacgccgaatattttgctgaggtcttcaagaaagaaaaggaggcccttattaaatga

SEQ ID NO: 11402 - RNA, 3384 nt, synthetic construct
  misc_feature 1..3384: note = Cas13b variant__Prevotella buccae__WP_004343973.1__Cas13b
  source 1..3384: mol_type = other RNA
atgcagaagcaagacaaactgttcgtggatagaaagaaaaacgccatctttgctttccccaagtacattacaatcatggagaataaagaaaagcctgagccgatttattacgaactcacagacaagcacttttgggccgcgttcctgaaccttgctcggcataatgtctatacgaccatcaaccacattaatcgcagactggagatcgccgaactcaaagatgacggctacatgatggggatcaagggaagctggaacgagcaggccaaaaagctggataaaaaggttcggcttcgcgacctgattatgaagcattttcccttcctcgaggctgccgcttatgaaatgacaaattccaaatctcctaacaataaggagcagagagaaaaagagcagagcgaggccctgtccctgaacaatctcaagaacgtgctgtttatcttccttgaaaaactgcaagtgctccggaattactattctcactacaagtacagcgaggaatcccccaaacctatttttgagacctctctgcttaagaacatgtataaggtcttcgatgcgaatgtgcgcctggttaaaagagactacatgcatcacgaaaacatcgatatgcagcgggactttacacacctcaaccgcaagaaacaggtgggcagaaccaagaatattatcgatagccccaacttccattatcactttgccgacaaagaggggaatatgacaattgctggactgctgttcttcgtctccctctttctggataagaaggacgccatctggatgcagaaaaagctgaaaggcttcaaggacgggcggaaccttcgcgagcaaatgaccaatgaagtgttttgcagaagccggatctctctccctaaactgaaacttgagaacgttcagacgaaggattggatgcagctggacatgctcaatgaactggtgcgctgtccgaaatccctgtacgagagactccgggaaaaggatagagagagcttcaaagtcccctttgacattttctctgatgactataacgctgaggaggaaccttttaagaataccctggtgcgccatcaggatcggttcccctactttgtgcttagatatttcgacctgaacgaaatctttgagcaactccgcttccagattgatctgggaacataccacttttccatctacaataaacggattggcgacgaagatgaggtcagacaccttacccatcacctgtatggcttcgcccgcatccaggacttcgcgcctcaaaaccagcccgaggaatggcggaagctcgttaaggacctggatcattttgagacaagccaggaaccgtacatctctaaaaccgcccctcactatcatctggagaatgagaagattgggatcaaattctgctccgctcacaacaatctctttcccagcctgcagacggacaagacatgtaacggaagatccaaattcaaccttggcacccaatttacagccgaagcgttcctgtctgtgcacgagctcctgcctatgatgttttactatctgcttctcaccaaggattacagccgcaaagaatccgccgacaaggtggaggggattatccggaaggaaattagcaatatctatgccatctacgatgctttcgcgaacaatgagattaactctatcgccgacctgaccagacgcctgcagaatacaaacattctccagggacatctgcccaaacagatgatctccattcttaagggccggcaaaaagatatggggaaggaggctgaaagaaaaatcggagagatgattgacgatacgcagcggcgcctggacctcctgtgcaagcagaccaatcagaagatcagaatcggcaaacggaacgccggcctgcttaagagcgggaaaattgccgattggctcgtcaatgacatgatgagatttcaacccgtgcagaaggatcagaacaatatccctattaacaattctaaagctaacagcacagaataccgcatgctgcagcgggccctggctctcttcggatccgagaattttagactgaaggcttatttcaaccaaatgaaccttgttggcaatgacaacccgcacccctttctggccgaaacccagtgggagcatcagacaaatatcctctctttctaccgcaactatctggaggccagaaagaaatacctgaaggggcttaaacctcaaaattggaagcagtatcagcacttcctcattctgaaagtgcagaagaccaaccggaatacgctggtcacaggatggaagaacagctttaatctcccccgcggcatcttcacccaacctatcagagaatggtttgagaaacacaacaattccaagcggatttacgaccagatcctgagcttcgatcgcgtggggtttgttgctaaagccattcccctttatttcgctgaagagtacaaggacaacgtgcagccgttttacgattatcctttcaatatcggaaacagactgaaacccaagaaacggcagtttctcgacaagaaggaacgcgtcgagctgtggcaaaagaataaggagctgttcaaaaactacccttctgaaaagaaaaagaccgatcttgcctatctcgactttctgtcctggaagaaattcgagagagaactgcggctcattaagaaccaggatatcgtgacatggctgatgttcaaagagctttttaatatggcgaccgtcgagggcctgaagatcggcgaaattcatctccgcgacatcgatacaaacacggccaatgaggaaagcaacaatattctgaacagaatcatgcccatgaaactgcctgtgaagacctacgagacagacaataaggggaacattcttaaagaacggcccctggctaccttctatatcgaggagacagaaaccaaggttctcaaacagggaaattttaaggccctggtgaaagatagacgcctcaacggcctgttctcttttgctgagacgaccgaccttaatctggaggaacacccgatctccaagctcagcgtcgatctggaactgattaagtaccagacaacccggatctccattttcgagatgacacttgggctggagaaaaagctcatcgacaaatattctaccctgcctacggacagctttagaaacatgctcgaacgctggctgcaatgtaaggccaatcggcccgagcttaaaaactacgttaattccctgattgcggtgagaaacgccttctctcataatcagtaccccatgtatgatgctacactctttgccgaagtgaagaagttcaccctgtttcctagcgtcgacaccaaaaagatcgagctgaacattgctccgcagcttctggaaatcgtgggaaaagccatcaaggagattgagaaatccgaaaacaagaattga

SEQ ID NO: 11403 - RNA, 3273 nt, synthetic construct
  misc_feature 1..3273: note = Cas13b variant__Prevotella sp.__WP_044065294__Cas13b
  source 1..3273: mol_type = other RNA
atgaacatccccgccctggtggagaatcagaagaaatacttcggcacctatagcgtcatggctatgctcaacgcccaaacagttctggaccacattcagaaggtggcggatatcgaaggggagcagaatgaaaacaatgagaacctttggtttcatcctgtgatgtcccacctgtacaatgctaaaaacggatatgacaagcagccggagaaaacgatgttcattatcgagagactccaatcttactttcccttcctgaagattatggccgagaatcagcgggaatatagcaacggcaagtacaaacagaatcgcgtcgaggtgaactccaatgatatctttgaagttcttaagagagccttcggggtgctgaaaatgtatcgggacctcaccaaccattacaagacatacgaggagaaactgaatgatggatgcgaatttctgacctctacagagcagcctctcagcggcatgatcaacaactattacaccgtcgctctgcgcaatatgaacgaaagatatgggtacaagacagaggaccttgccttcattcaagataagcggtttaaattcgtgaaggacgcttatggaaagaagaaatcccaggttaataccggctttttcctgtctctccaggattacaacggcgacacgcagaagaaactgcaccttagcggggtgggaatcgccctgctcatttgtctgtttctggataagcaatatatcaatattttcctctcccgcctgcccatcttcagctcttacaacgcgcagtccgaagagagacggattatcatccgcagctttggcattaattctatcaaacttcctaaagaccggattcattccgaaaagagcaacaaatctgtcgccatggatatgctgaatgaagtgaagagatgccccgacgaactcttcaccacactgtccgctgaaaaacagagccgctttagaatcatttccgacgatcacaacgaggtgcttatgaagcggtctagcgaccgcttcgtccctctgctcctgcaatacatcgattatgggaagctgtttgaccacatcagattccatgttaatatgggaaaactccggtacctgcttaaggccgataaaacctgtattgacggccagacaagagtgcgcgtgatcgaacagccgctgaacgggtttggacggctcgaggaggctgaaaccatgagaaagcaggagaatggcacgttcggcaactccgggattcgcatccgggattttgaaaatatgaaaagagacgatgccaaccccgcgaactatccttacattgtcgacacatatacccactacatcctggagaataacaaggtggaaatgttcatcaatgataaggaggacagcgctccccttctgcctgttattgaggacgatcgctatgtggtcaaaacaatcccctcttgccggatgtccaccctcgaaattccggctatggcctttcatatgttcctgtttggaagcaagaaaaccgagaagctgatcgtggacgttcacaacagatacaaacgcctcttccaagctatgcagaaggaagaggtgacagccgagaatattgcctctttcggcatcgctgaaagcgatctgcctcagaagattcttgacctgatctccgggaacgcgcacggaaaagatgtcgacgcctttatccggctcacggtggatgacatgctgaccgatacagagagacgcattaagcggttcaaagacgatagaaagtctatccggagcgctgacaataaaatgggcaagcgcgggtttaaacagatttccaccggaaagctggccgatttccttgccaaggacatcgtcctctttcaacccagcgtgaacgacggcgaaaataaaattacaggcctgaactacagaatcatgcagtctgctatcgccgtttatgattccggggacgattacgaggcgaagcagcagttcaaactgatgtttgaaaaggctcggctcattggaaaaggcaccacggagcctcatcccttcctgtataaggtgtttgccagaagcatccccgccaatgctgtcgagttctacgaacgctatcttattgagcggaagttttacctgacagggctctctaacgaaatcaaaaagggaaatagagtggacgttcctttcattcgcagagatcaaaacaaatggaagaccccggccatgaaaaccctgggccggatctattccgaggacctgcccgtggaacttcctcgccagatgtttgataatgagatcaagagccacctcaagtccctgccccagatggaggggattgacttcaacaacgctaatgtcacatacctgatcgccgaatacatgaaaagagtgctcgatgacgatttccagaccttttatcaatggaaccggaattaccgctatatggacatgctgaagggcgagtacgatagaaaaggatctcttcagcattgtttcacaagcgtggaggagcgggaaggcctgtggaaggagcgcgcgtccagaacggagcggtatcgcaaacaggcctctaacaagattagaagcaatcggcaaatgagaaacgcttccagcgaagagatcgaaaccattctcgacaagcgcctgtctaattcccggaacgagtaccagaaaagcgagaaggttatcagacgctatcgggtccaggacgccctgctttttctcctggctaaaaagacactgaccgaactcgccgatttcgacggggagagatttaaactgaaggaaatcatgcctgatgcggagaaaggcattctttctgaaatcatgcccatgtccttcacatttgagaagggagggaagaaatacaccattacgagcgagggaatgaagctgaaaaattacggcgacttctttgtgctcgcctctgataagcgcatcgggaacctgctggaacttgtgggcagcgacattgtctccaaagaggatatcatggaagagttcaataagtatgaccagtgccggccggaaattagctctatcgtgtttaacctcgagaagtgggctttcgatacctaccctgagctgtccgccagagttgaccgcgaagagaaagtggatttcaagagcatcctgaaaattctcctgaataacaagaatatcaacaaagaacaatccgacattcttcggaagatcagaaacgcttttgaccacaataactatcccgataagggagtcgtggagattaaagccctgcctgaaatcgccatgtctatcaagaaagccttcggcgagtacgcgattatgaagtga

SEQ ID NO: 11404 - RNA, 4152 nt, synthetic construct
  misc_feature 1..4152: note = Cas13b variant__Artificial____PspCas13b-GS-HsADAR2DD(E488Q,del984- 1090)
  source 1..4152: mol_type = other RNA
atgaacatccccgccctggtggagaatcagaagaaatacttcggcacctatagcgtcatggctatgctcaacgcccaaacagttctggaccacattcagaaggtggcggatatcgaaggggagcagaatgaaaacaatgagaacctttggtttcatcctgtgatgtcccacctgtacaatgctaaaaacggatatgacaagcagccggaaaagacgatgttcattatcgagagactccaatcttactttcccttcctgaagattatggccgagaatcagcgggaatatagcaacggcaagtacaaacagaatcgcgtcgaggtgaactccaatgatatctttgaagttcttaagagagccttcggggtgctgaaaatgtatcgggacctcaccaacgcttacaagacatacgaggagaaactgaatgatggatgcgaatttctgacctctacagagcagcctctcagcggcatgatcaacaactattacaccgtcgccctgcgcaatatgaacgaaagatatgggtacaagacagaggaccttgctttcattcaagataagcggtttaaattcgtgaaggacgcctatggcaaaaagaaatcccaggttaataccggatttttcctgtctctccaggattacaacggcgacacgcagaagaaactgcatcttagcggggtgggaatcgcgctgctcatttgtctgtttctggataagcaatatatcaatattttcctctcccgcctgcccatcttcagctcttacaacgcccagtccgaagagagacggattatcatccgcagctttggcattaattctatcaaacttcctaaagaccggattcactccgaaaagagcaacaaatctgtcgctatggatatgctgaatgaagtgaagagatgccccgacgaactcttcaccacactgtccgccgaaaaacagagccgctttagaatcatttccgacgatcataacgaggtgcttatgaagcggtctagcgaccgcttcgtccctctgctcctgcaatacatcgattatgggaagctgtttgaccacatcagattccacgttaatatgggaaaactccggtacctgcttaaggctgataaaacctgtattgacggccagacaagagtgcgcgtgatcgaacagccgctgaacgggtttggacggctcgaggaggccgaaaccatgagaaagcaggagaatggcacgttcggcaactccgggattcgcatccgggattttgaaaatatgaaaagagacgatgcgaaccccgccaactatccttacattgtcgacacatatacccattacatcctggagaataacaaggtggaaatgttcatcaatgataaggaggacagcgctccccttctgcctgttattgaggacgatcgctatgtggtcaaaacaatcccctcttgccggatgtccaccctcgaaattccggccatggcttttcacatgttcctgtttggaagcaagaaaaccgagaagctgatcgtggacgttcataacagatacaaacgcctcttccaagccatgcagaaggaagaggtgacagccgagaatattgcttctttcggcatcgcggaaagcgatctgcctcagaagattcttgacctgatctccgggaacgcccacggaaaagatgtcgacgcttttatccggctcacggtggatgacatgctgaccgatacagagagacgcattaagcggttcaaagacgatagaaagtctatccggagcgccgacaataaaatgggcaagcgcgggtttaaacagatttccaccggaaagctggccgatttccttgctaaggacatcgtcctctttcaacccagcgtgaacgacggcgaaaataaaattacaggcctgaactacagaatcatgcagtctgccatcgcggtttatgattccggggacgattacgaggctaagcagcagttcaaactgatgtttgaaaaggcccggctcattggaaaaggcaccacggagcctcaccccttcctgtataaggtgtttgccagaagcatccccgctaatgccgtcgagttctacgaacgctatcttattgagcggaagttttacctgacagggctctctaacgaaatcaaaaagggaaatagagtggacgttcctttcattcgcagagatcaaaacaaatggaagaccccggctatgaaaaccctgggccggatctattccgaggacctgcccgtggaacttcctcgccagatgtttgataatgagatcaagagccatctcaagtccctgccccagatggaggggattgacttcaacaacgccaatgtcacatacctgatcgcggaatacatgaaaagagtgctcgatgacgatttccagaccttttatcaatggaaccggaattaccgctatatggacatgctgaagggcgagtacgatagaaaaggatctcttcagcactgtttcacaagcgtggaggagcgggaaggcctgtggaaggagcgcgcctccagaacggagcggtatcgcaaacaggcttctaacaagattagaagcaatcggcaaatgagaaacgcctccagcgaagagatcgaaaccattctcgacaagcgcctgtctaattcccggaacgagtaccagaaaagcgagaaggttatcagacgctatcgggtccaggacgctctgctttttctcctggccaaaaagacactgaccgaactcgcggatttcgacggggagagatttaaactgaaggaaatcatgcctgatgccgagaaaggcattctttctgaaatcatgcccatgtccttcacatttgagaagggagggaagaaatacaccattacgagcgagggaatgaagctgaaaaattacggcgacttctttgtgctcgcttctgataagcgcatcgggaacctgctggaacttgtgggcagcgacattgtctccaaagaggatggaagcctccagctgccgcctctggaacggctcaccctgggctctcaacttcatctgccccaggtgctcgccgacgctgtttccagactggtgctggggaagttcggagatcttacagacaattttagctcccctcacgcccgccggaaggtcctggccggcgtggttatgaccacagggaccgatgtgaaagacgctaaggtcatctctgtgagcacgggaacaaaatgcattaacggcgagtatatgtccgacagagggctcgcgctgaatgattgtcatgccgaaatcatctctcggcgcagcctcctgagattcctttacacccagctggagctctatctgaacaataaggacgatcagaaacggtccattttccaaaagtctgagcgcggcggatttagactgaaggaaaacgttcagttccacctttacatcagcacatccccctgcggcgacgctcggatttttagccctcacgagcccatcctggaggagccggccgatagacatcctaaccgcaaagcccgggggcagctcagaaccaagattgaatctggacagggcaccatccccgtgcgctccaatgctagcatccaaacatgggacggggtcctgcagggagagcggctcctgacgatgtcttgttccgataaaattgccagatggaacgtggtgggcatccaggggagccttctgtctattttcgtcgagcccatctatttttccagcattatcctcggctccctgtaccacggagaccatctgagccgcgcgatgtatcaacggatctctaatattgaagatcttcctccgctgtacaccctcaacaagcccctgctcagcggcatctccaatgctgaggccagacagcctgggaaagcccccaacttctctgttaattggacagtgggagacagcgctattgaagtgatcaacgccaccacaggcaaggatgagctggggcgcgcgtccagactttgcaagcacgctctgtactgtcggtggatgcgcgtccacggaaaagtgccttctcatctgctcagaagcaagattaccaaacccaatgtttatcacgagtccaagctggccgccaaagaataccaggctgccaaggctcggctttttacggccttcatcaaggcgggcctgggcgcctgggtggagaaacctacagaacaggaccaattttctctcacctga

SEQ ID NO: 11405 - RNA, 4152 nt, synthetic construct
  misc_feature 1..4152: note = Cas13b variant__Artificial____PspCas13b-GS-HsADAR2DD(E488Q,T375G,d el984- 1090)
  source 1..4152: mol_type = other RNA
atgaacatccccgccctggtggagaatcagaagaaatacttcggcacctatagcgtcatggctatgctcaacgcccaaacagttctggaccacattcagaaggtggcggatatcgaaggggagcagaatgaaaacaatgagaacctttggtttcatcctgtgatgtcccacctgtacaatgctaaaaacggatatgacaagcagccggaaaagacgatgttcattatcgagagactccaatcttactttcccttcctgaagattatggccgagaatcagcgggaatatagcaacggcaagtacaaacagaatcgcgtcgaggtgaactccaatgatatctttgaagttcttaagagagccttcggggtgctgaaaatgtatcgggacctcaccaacgcttacaagacatacgaggagaaactgaatgatggatgcgaatttctgacctctacagagcagcctctcagcggcatgatcaacaactattacaccgtcgccctgcgcaatatgaacgaaagatatgggtacaagacagaggaccttgctttcattcaagataagcggtttaaattcgtgaaggacgcctatggcaaaaagaaatcccaggttaataccggatttttcctgtctctccaggattacaacggcgacacgcagaagaaactgcatcttagcggggtgggaatcgcgctgctcatttgtctgtttctggataagcaatatatcaatattttcctctcccgcctgcccatcttcagctcttacaacgcccagtccgaagagagacggattatcatccgcagctttggcattaattctatcaaacttcctaaagaccggattcactccgaaaagagcaacaaatctgtcgctatggatatgctgaatgaagtgaagagatgccccgacgaactcttcaccacactgtccgccgaaaaacagagccgctttagaatcatttccgacgatcataacgaggtgcttatgaagcggtctagcgaccgcttcgtccctctgctcctgcaatacatcgattatgggaagctgtttgaccacatcagattccacgttaatatgggaaaactccggtacctgcttaaggctgataaaacctgtattgacggccagacaagagtgcgcgtgatcgaacagccgctgaacgggtttggacggctcgaggaggccgaaaccatgagaaagcaggagaatggcacgttcggcaactccgggattcgcatccgggattttgaaaatatgaaaagagacgatgcgaaccccgccaactatccttacattgtcgacacatatacccattacatcctggagaataacaaggtggaaatgttcatcaatgataaggaggacagcgctccccttctgcctgttattgaggacgatcgctatgtggtcaaaacaatcccctcttgccggatgtccaccctcgaaattccggccatggcttttcacatgttcctgtttggaagcaagaaaaccgagaagctgatcgtggacgttcataacagatacaaacgcctcttccaagccatgcagaaggaagaggtgacagccgagaatattgcttctttcggcatcgcggaaagcgatctgcctcagaagattcttgacctgatctccgggaacgcccacggaaaagatgtcgacgcttttatccggctcacggtggatgacatgctgaccgatacagagagacgcattaagcggttcaaagacgatagaaagtctatccggagcgccgacaataaaatgggcaagcgcgggtttaaacagatttccaccggaaagctggccgatttccttgctaaggacatcgtcctctttcaacccagcgtgaacgacggcgaaaataaaattacaggcctgaactacagaatcatgcagtctgccatcgcggtttatgattccggggacgattacgaggctaagcagcagttcaaactgatgtttgaaaaggcccggctcattggaaaaggcaccacggagcctcaccccttcctgtataaggtgtttgccagaagcatccccgctaatgccgtcgagttctacgaacgctatcttattgagcggaagttttacctgacagggctctctaacgaaatcaaaaagggaaatagagtggacgttcctttcattcgcagagatcaaaacaaatggaagaccccggctatgaaaaccctgggccggatctattccgaggacctgcccgtggaacttcctcgccagatgtttgataatgagatcaagagccatctcaagtccctgccccagatggaggggattgacttcaacaacgccaatgtcacatacctgatcgcggaatacatgaaaagagtgctcgatgacgatttccagaccttttatcaatggaaccggaattaccgctatatggacatgctgaagggcgagtacgatagaaaaggatctcttcagcactgtttcacaagcgtggaggagcgggaaggcctgtggaaggagcgcgcctccagaacggagcggtatcgcaaacaggcttctaacaagattagaagcaatcggcaaatgagaaacgcctccagcgaagagatcgaaaccattctcgacaagcgcctgtctaattcccggaacgagtaccagaaaagcgagaaggttatcagacgctatcgggtccaggacgctctgctttttctcctggccaaaaagacactgaccgaactcgcggatttcgacggggagagatttaaactgaaggaaatcatgcctgatgccgagaaaggcattctttctgaaatcatgcccatgtccttcacatttgagaagggagggaagaaatacaccattacgagcgagggaatgaagctgaaaaattacggcgacttctttgtgctcgcttctgataagcgcatcgggaacctgctggaacttgtgggcagcgacattgtctccaaagaggatggaagcctccagctgccgcctctggaacggctcaccctgggctctcaacttcatctgccccaggtgctcgccgacgctgtttccagactggtgctggggaagttcggagatcttacagacaattttagctcccctcacgcccgccggaaggtcctggccggcgtggttatgaccacagggaccgatgtgaaagacgctaaggtcatctctgtgagcacgggaggcaaatgcattaacggggagtatatgtccgacagaggcctcgcgctgaatgattgtcatgccgaaatcatctctcggcgcagcctcctgagattcctttacacacagctggagctctatctgaacaataaggacgatcagaaacggtccattttccaaaagtctgagcgcggaggctttagactgaaggaaaacgttcagttccacctttacatcagcacctccccctgcggggacgctcggatttttagccctcacgagcccatcctggaggagccggccgatagacatcctaaccgcaaagcccggggacagctcagaacaaagattgaatctggccaggggaccatccccgtgcgctccaatgctagcatccaaacctgggacggagtcctgcagggcgagcggctcctgacaatgtcttgttccgataaaattgccagatggaacgtggtggggatccagggcagccttctgtctattttcgtcgagcccatctatttttccagcattatcctcggatccctgtaccacggcgaccatctgagccgcgcgatgtatcaacggatctctaatattgaagatcttcctccgctgtacacgctcaacaagcccctgctcagcgggatctccaatgctgaggccagacagcctggaaaagcccccaacttctctgttaattggaccgtgggcgacagcgctattgaagtgatcaacgccacaaccgggaaggatgagctgggacgcgcgtccagactttgcaagcacgctctgtactgtcggtggatgcgcgtccacggcaaagtgccttctcatctgctcagaagcaagattacaaaacccaatgtttatcacgagtccaagctggccgccaaagaataccaggctgccaaggctcggctttttaccgccttcatcaaggcgggcctgggggcctgggtggagaaacctacggaacaggaccaattttctctcacatga

SEQ ID NO: 11406 - RNA, 2862 nt, synthetic construct
  misc_feature 1..2862: note = Cas13b variant__Alistipes sp.__WP_047447901.1__Cas13b
  source 1..2862: mol_type = other RNA
atgagcaacgagatcggcgccttcagagaacaccagtttgcttacgcccccgggaatgagaagcaagaagaggcgaccttcgctacatattttaacctggccctctccaatgtggaaggaatgatgttcggcgaggtcgagtctaaccctgacaaaattgaaaagagcctggatacgcttccgcccgccatcctgcggcagattgcttcctttatctggctctctaaagaggaccatcctgataaggcctacagcaccgaagaggttaaagtgattgtgacagacctggtccgcagactttgcttctatcggaattacttttcccactgtttctatctggatacccagtacttttattctgacgagctcgtggatacaaccgctatcggggaaaagctgccctacaacttccatcactttatcacaaatcgcctgttcagatacagcctccctgagattaccctgtttcggtggaacgaaggagagcgcaagtatgaaatccttagagacggcctgattttcttctgctgtctctttctgaaacgggggcaggccgagcgcttccttaatgagctgagatttttcaagcggacggatgaagagggacgcatcaaaagaaccatttttacaaagtactgcacccgggaatcccataaacacatcggcattgaggaacaagacttcctcatctttcaggatatcattggcgacctgaaccgcgttcccaaggtgtgtgatggggtcgtggacctgagcaaggagaatgagagatatatcaaaaaccgggaaacatctaatgagtccgacgaaaacaaggcgagataccgcctcctgattcgggagaaagataagttcccttattaccttatgagatatatcgttgactttggagtgctgccgtgcattaccttcaaacagaatgattacagcacgaaggaaggccgcgggcagtttcactaccaagacgccgctgtcgcccaggaggagcggtgttataacttcgtggtgagaaacggaaatgtctactattcttacatgccccaggctcagaacgttgtgcgcatctccgaactccaaggcacaatcagcgtggaggaactgcggaatatggtctatgcctctattaacgggaaagatgtgaataagtccgttgagcagtacctttatcatctgcacctcctgtacgagaagatcctgaccattagcggacagacaatcaaagaaggcagagtggacgtcgaggattaccgccctctcctggacaaacttctgctccggcccgcgtccaacggcgaagaactgagacgcgaacttcggaagctgctccctaagagagtgtgcgatctgctgtctaatcggtttgactgtagcgagggggtttccgccgtggagaaacgcctcaaggctattctgcttagacatgaacaactgctcctgagccagaaccccgccctgcacatcgataagatcaaatctgtcattgactatctttacctcttcttctccgacgatgagaagtttcggcagcagccgaccgaaaaagctcacagaggactgaaggacgaggagttccaaatgtatcattacctggtgggcgattatgacagccaccctctcgccctgtggaaagagcttgaggcctctgggcgcctgaagcccgaaatgcggaagctcaccagcgctacatccctgcatggactgtacatgctttgcctcaaaggcacggtcgagtggtgtagaaagcagctgatgtctatcgggaaaggaaccgcgaaggtggaagccattgctgatcgcgttggcctgaaactctatgacaagctgaaggagtacacacctgaacagcttgagagagaggtgaaactggtcgtgatgcacggctacgccgccgctgccacccccaagcccaaagcgcaggctgccatccctagcaagctcacagaactgcggttttattccttcctggggaaacgcgagatgagctttgccgctttcattagacaagataagaaagcccagaaactttggctccggaatttttacaccgttgaaaacatcaagacgctgcagaagcgccaggctgccgcggacgccgcttgcaagaaactgtataatctcgtgggagaggtcgagagagtgcatacaaacgataaggtgctggttcttgtcgcccaacggtaccgcgaaagactgctcaatgtgggctctaaatgcgctgtgaccctggacaacccggagcggcagcagaagctggccgatgtctatgaagtgcagaatgcgtggctttccattcgcttcgacgatctcgactttaccctgacacacgttaacctgagcaacctcagaaaggcctacaatctgatcccccggaaacacatccttgctttcaaggagtatctggacaacagagtgaaacaaaagctctgtgaagagtgccgcaatgtccggagaaaagaggatctgtgtacctgctgttctcctcgctactccaacctgacaagctggcttaaggaaaatcattccgagtctagcattgaacgggaggccgctacgatgatgctgctcgacgtggaaagaaagctgctctcctttctgcttgatgagcgccggaaagccatcattgagtacgggaagttcatccccttttctgccctggttaaagaatgcagactcgctgacgcgggactgtgtggcattcgcaacgatgtgctgcacgacaatgtcatcagctatgccgatgctatcgggaaactttccgcctacttccctaaggaggccagcgaagctgtggagtatattcggagaaccaaggaagttcgggagcagcgcagagaggaactgatggccaactcttcccagtga
